United States Patent 7,745,391 (HUMAN THROMBOSPONDIN POLYPEPTIDE) - sequence listing, part 24

SEQ ID NO: 58120 - DNA, 555 bp, Homo sapiens
atatccaaatagaggaatatagaaaaatttaattgattccaaaagtagaggagacagaatcacttatccttgttacactgcttttcttcatctcttgccctttcctttcacatacattttttccctcttctcattattacctgtctttcaaacactgtattctgcctttgcaacactgagatccaaatacccacaagtggttaacttgtgtcatcacaagatctataaggtgaactgtaataaatgcaagtatactgaggcaggagaatcgcttgagcctgggaggcagaggttgcagtgagctgagatcaagccactgcactccagcttgggtaacagagcgagactctgtccctaaatcaataaatcaataaatgcaagtgtagttcacgtcaaggttagttctctgaactttctcattcctatggatgcaaacactgtatctaatttaaatggaaactctttcaatctataaattgccttcttctttacaatatagccttagatgtacttttttaaattcaacacagacttgaagaaaatgggctaaatgca

SEQ ID NO: 58121 - DNA, 400 bp, Homo sapiens
  misc_feature (52)..(52): n is a, c, g, or t
ttactaatctaggcacagccggaattggttactggactaggcacagccgganttagttactaatctaggcacagccggaattggttactaatctaggcacagccggaattagttactagtctaggtacagccggattagttactaatctaggtacagccgggttggttactaatctaggtacagccgggttagttactaatctaggtacagctggattagtaactaatgtaggtacagctggattagtaactggttgattgaccacactattaggtacaaacaaatggctcaatatcataatataggggattcctgtggcatattgcaaggatattttcggccttatcttggtcacaagtttttttcaataactgggatgaaaacatattcattagattt

SEQ ID NO: 58122 - DNA, 766 bp, Homo sapiens
ccaaagtgctaggattacaggtgtgaaccagtactttatttctgacaccagatatgtaggagttttcccccacacatcaaccagttctccaactgggtatccggtaactcactttaattctgacaccgtctgcctggagactaccacaagactgccttcactcagacactaatctcaattcacaggttgtgaccagtgcttctaatctactggctataagtcagggttcccatgaccactctttttgctttgataattagctaggacggctcacagggaaacactttacttatgtttaacagtttattataaagaatattataaatgatacagatgaacagccagatgaagtaatgcattgggcaaggtatgcggtgggagaggtgcagagcttctgtgccctctctgggtgcaccaactccccagcatccccctgtgttcaactaccctgaagctaatcacatctagtggttcaggagtgtctaggctgggtgcagtggctcacacctataatcccagcactttgggggaccaaggtaggaggatcacttgatcccaggagtttgagacaaacctgggctaacacagtgagatcccgttcaaaaaatcttataaaaattagctgggcatggcggcgcacacctgtagtcccaactacttgggaggctgaggtgagagggtcacttgagcccagaggttgaggctgcagtgagctatgatcatgccactgcatcacagcctgagtaaaaaagcaagagcctgtctc

SEQ ID NO: 58123 - DNA, 663 bp, Homo sapiens
gaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaa

SEQ ID NO: 58124 - DNA, 297 bp, Homo sapiens
tcttcctttagttcagaggctcatgctgtcctgaggtaaagcttgaagaccttgcactctttcctcctaccaggcatttggtgttttctgatcccgtgtggtcccaaagacccgagggtcaccatgatggaagtctccctgcagggactgggcctgctgggcttcccttagttccctttccagtgcagctgtcttggacttttccaaattcagctgctgctagagctcttctgctttccccagggagggccagggccaatttctgaccagagctgctgcagaaggtctctctcctgg

SEQ ID NO: 58125 - DNA, 315 bp, Homo sapiens
aatcctgggggtgatttagaacttagaggcattctcaaaatggaccaagctaaatggtagcctttattttctgtaatgattcaccatgggaaaattagtaattctttaaacttcttacttaatcttatatgtattccaaattttctaaaaagaaattaacctagaggttttacagaactccattttttttttattttccagaaaggaaaaatttatctgtgctgttattttgttaaaaatcctattccagctactactatggaaaaaggaaaagaagaaaggaggaaaggaagggagagaggaaaggaagggacg

SEQ ID NO: 58126 - DNA, 458 bp, Homo sapiens
ttccatgtgcagaacaagcccccgtattcctccccggaattgtgtagatttctccctccccaacccaagtaaggaaaacaaacctgtataagtgccatgaaatccagaattgggtattttgcccttgattaagtgacccccatcacctaattggggaagttattgagatgtattttaaaacaaaaccctggatataagagatgaagtaaatcactggtgaagcactgcctcctttccagatagaaattttatctgcaaagtcagaagtcactgaatattttctgcctcgcctcttctctcactgactaggctctttctggtcctctgccctgatgctagatggagttagagaccctggggcagacccatgaacaaacatctgtttcttctgccactgacttgtatctttttcttatagtcaattattctaattttattgtaaatatagcttagttaaa

SEQ ID NO: 58127 - DNA, 284 bp, Homo sapiens
aagaaaagagtccttaaaatcaataacaataccaacaaagccaacctttacacagattgaaaaaaaatggccagcagtaaccaaacaaggaaatatatcacatacctagaaaactagcagccaataaaggataattctagcataggagattctgtctccactctttagaaaacagcactgaccagagaaggagattttatgaaccctaagaactcttgctaccaccttgattttatgggggagacagagtgagcaggtgagtcagcaattgcagagaaagatca

SEQ ID NO: 58128 - DNA, 298 bp, Homo sapiens
cctcaggccttgttgtagtggtgggaaggacagatcaatccccacgcccctggtaacatgcatgagtattgacagtggcagacaaggcagggctgtcattaagctctccaatggtgtatgcaggtgctggctgtagtgagagaggaggattgacccccatactcctggatggcatggtggagcactggcagtggtgacattgggtggggcagacctatcctcaagtccccagatggcaaacatgggcactggtgggggcaggcagggcagcctgatcccaagactcccagatggcatg

SEQ ID NO: 58129 - DNA, 353 bp, Homo sapiens
ggaccatgactttataagtccaccaatgatataactgtaaagtaactctctcagaacgtggactacgctattgaatcagaacaccaatttcactcgttatacaaacccacaaagcttcaactagcagaagttttgcatttttatccactttgagacaaaagaagtaatccatagaaaaggaaaactgttgctttaaatgaaagctctgacacaaatatgcaaacacaacaaactgctttccactgcgcacacactgagtttatccaggagctgggtgactcgcctgtcctctaccacccacacccactcggacatgggaacatgggtgcaagacatgaggagcaagagccgca

SEQ ID NO: 58130 - DNA, 1620 bp, Homo sapiens
gtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccaggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttccctttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctg

SEQ ID NO: 58131 - DNA, 445 bp, Homo sapiens
  misc_feature (64)..(64): n is a, c, g, or t
  misc_feature (174)..(174): n is a, c, g, or t
gctactcaaaagcaggcagcagttagcagcctctctgctgcttgctgacacagttcagaaaggntaggcattctgtcgttggcaggagacagagcttgaggactttgtcaaagcccagcgtcctccagttccatacgtgtatatatgtacatgtgtgtatataaaggtatattngtgtgtgtgcactggaaaagcacctgccacttccaaaagtcagccgtattgtattcacagtcacagagccgattttataatacatttattcagtaaatatttacttagcacctattgtatgtacttgtataatgagaaagaaaacaaatttttacaagatttttactgaggaaattcaaaactttaaggacactggtatttgaaattcatgtaatttttacatgtcataaaatagttttttgtttcctcctaaccatttagaaatggtaaa

SEQ ID NO: 58132 - DNA, 536 bp, Homo sapiens
aattttacccagtaaccacgagcagtaagtttaattgggaagttttgttgaaacataactctaaaattgtggaaaaatgtcaacactttaaaattagtgcctaataattttaattctcttggtactcactgcagtatcattaatcatgatggagtcattcgatcctaatatggatgtaatatccaattctgcagagattcagctgtaatttagcaacaattaactgtccacttattataaagtgatgccaaaaaccctaatgcaattattttaaggcgttggtcacattaacaatagcattcaagtttgcagatgttgcagaaactttagattgatgtgtctgattaaaaacacattacgttggaaattttcttactttaggtatttatgctggtatttcagaaggcactttcggtttcatctttggaatagctctcatttacttttgtgcctttcttaaaattttatttctgcatatttgctttgaggaaaacaaattgatgtgttttctaaacatatgcaacttttgaggagat

SEQ ID NO: 58133 - DNA, 268 bp, Homo sapiens
gtgggggaaaggtccttctccctcctctgaagctgcctctcactgtgtaatctcaggccagtcactgtctctttctgggcctcagtttccccatctgcaaaatgaaggggtcagactaggagacctttaatatctctcccagctctgagattcgttctaggcttccattctgactgctaggcagtggaggtcagtcccccttattggggacaatacggcagggatgaggttcaaagtcctgcccagagaccattcccacatgaagcca

SEQ ID NO: 58134 - DNA, 850 bp, Homo sapiens
gtgacggagggctggagctccagggtgctcacaggggaaagagcaagccagggatataaggaaaatgtttgggaaaacaaagcctgtctttttctctgagttcttctctattgctcccctggaccgagctctcctaaggcctttgtcataatcacccatttcaataaaaatatcttatatttaaaaagaatatgtaagggaaagaatattgtattggatactaggagaccagctaggttctcatctctttcatgtcgcaaacctgctatgttatcagacatttcaacctctctggactacaggagaaaaaaaaaagaagggagggatacagaaggaattcatatagtgagaagaccatgctctctccaagccagctttccagaattcccttcaatgtgccttgggagtctcacctccttccttgccatagtcccaccaggcctccacggtgccgaggtagaagcaggtcctcaggtccctttaactgaattgagtcatggctcaccaccactaccaccagcaaacgccctctcttcttgctgccgcagcacctagggatttcctattccttctcctcaccagctaatcacaatctacctatagcctcagtagggggtctctatgcctgatgcctccattcacacctctggagctcctctcctgccctcttctgctgtggtacattggcctctcctgctcctgtccatcttcacaactgtcatttgcccatccctaaatccatcatccttgcccaaaagattcccactgcccagggaaggagtcaggaagaacaggaagaactgtaagaagatacatagagcatgtttggaggcctaaagaaataaactta

SEQ ID NO: 58135 - DNA, 389 bp, Homo sapiens
caggttcaagcgatcctcctgcctcagcctaccaagtagctggcattacagatgcacaccaccatgcccggctaatttttgcatttttaatggagacaaagtttcaccatgtttgccagggtcgtctcgaactcctgaactcaagtaatctgcccatcatggcctcccaaagtgctgggatcacagacgtgagccctcgcacctgagattgttcttattactctcatgttacaaatgaggaaacaactagtgaaattagtgaaattgttctctttttcttttctttttttttttgggagacagagtctcgctttatcatcctggctggaatgtgcattggcccgatctcagctcactgcaacctccactttctgggttcaagtgatcct

SEQ ID NO: 58136 - DNA, 226 bp, Homo sapiens
ctaaaggttaaatgactctgaggcaaggtggaagaactggcttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagaagaaccacatgtcaacacaccggctctctcttcacag

SEQ ID NO: 58137 - DNA, 7111 bp, Homo sapiens
aacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaataacacatgaggggtctatcaaaaa

SEQ ID NO: 58138 - DNA, 4706 bp, Homo sapiens
gcctcgtgccgaatcggcacgaggcggcacgaggccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaataacacatgaggggtctatcaaaaa

SEQ ID NO: 58139 - DNA, 5171 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgatacccctgcactccagcctgggcaacaaagcaagaccctgtctcttg

SEQ ID NO: 58140 - DNA, 3919 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcat

SEQ ID NO: 58141 - DNA, 2909 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggaggtctgccaccttaagacccctattttaagatgcacacacacactggtgcccactcctgggtatttcttcatagcttagctccactctggaagaccccagcccagtaaccagagcccagtttatttccccaccactgcacagcacaggtccagaccaggtagccccaggctgtactcaagtctcactgccccttatggggcagactggccaagaactggggcatgggctttcagacagaaggactttgtatacagtgttctatcaggtcccctgtccctagccctgtcacctgtctcttttagcatgcccaagcttgggactgccatcttatcacgttcctactccagttagcacatcccccgcaattatttttgttttccataggttcacagaagtgttgaaagattcaagtatgaaaattagctatccctctccctcgaaagagctactttcatgaaacaaagtcttgcctgaatattctgggtggctaagaattagcccagacatacctcctgtggactccttttattacttccctgcctttcctagaccagctttccttagtggccagtgtagacttggctttagaatgcctgtacccgtaagagtctaacggtagccaaagttgggccccaaaggccactttctaagagctgccatctctcatacttctaatggggtggtccattgggaaggacacaggtcatgtgtggctccaaggagctttgtagcatctatatcagtgtgaacacatagaaggagtccagggcttgggggaaccacatggcttcttagataaaggaagcccaatttaaaatgaagattaatggagtggattacagggacacttaaaagataaaagtaattatattctgtgaaattcagcaagctgtttattgagcgcaaaccatgttcgagacgttcctaaatgaactgagttgtcaaggcagaaggttgtaattggtcttctcttctccttatagtgacagtcactgtccccaagttactcagtgctgctatttctcctgggagtcagatctaagtatgtttttacagagactccgagagatattccagaaatgaagtcccaaaacaaatcactttctaatgtgtgtggtaacaatgcatgtaaataggagtaccatatatgtatgtacttgcatacataaatatctagcatgggattacttaagtctctaacagtgcctgcattttgagatattagaataattgactaggctgtagcatgaataattctatttgcaatgagtgtgaagtcactaccaagaaaagagagttatcagatacccacattaagattctgttgattctttacacaggcctatcattttttttttaaatagactccctgttttagtaagatcatctagatttataattcatttgactaacctataattttgaactccataaacaaatgtaagggaacttctgttacagtaaggaaaagtttgcttggacaaaaggaaaagtgggctgggcgtgatggctcacgcctataagcactttgggaggccgaggtggacagatcacttgaggttaggagttcaagacccagcctggccaacatggcgtacccccttgtctacaaaaatactgggcgtgatggtgtgcgcctgtaatcccagctacttagaaggttgagccaggagaattgcttgaacccgggaggtggaggttgcagtgagccaagactatgcactgccctttagcctaggcaacagaatgagactccatct

SEQ ID NO: 58142 - DNA, 7081 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaataacacatgaggggtctatcaaaaa

SEQ ID NO: 58143 - DNA, 4507 bp, Homo sapiens
ctcagcctctcctgttccttctggcttccgccgcctggcatgagctctgtcacagtcgccggcgacgtcgctctggagaaagcggccagctgctggttgaattctggggttggtttctgcagaatcaccaagacgtgctccaggaggtccaagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaataacacatgaggggtctatcaaaaa

SEQ ID NO: 58144 - DNA, 5070 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaataacacatgaggggtctatcaaaaa

SEQ ID NO: 58145 - DNA, 3361 bp, Homo sapiens
gtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcat

SEQ ID NO: 58146 - DNA, 560 bp, Homo sapiens
tgcgctgggagcctcgcgccctttgacagcagttagttgctgactcggatgcagagagtcggtaacaccttctccaacgagagccgggtggcatcccggtgtcccagcgtgggccttgctgaacggaaccgggtggccacaatgccggtgcggctgctcagggacagtccagcggctcaggaggacaatgaccatgccagagacggtttccaaatgaagctggatgcccacggcttcgccccggaggaactggtggtgcaggtggatggccaatggctgatggtgaccggacagcagcaactggacgtcagggacccggaaagggtcagttaccgcatgtcacagaaggtgcaccggaaaatgctcccgtccaacctgagtcctaccgccatgacctgctgcctgaccccctccgggcagctgtgggtcagaggccagtgtgtggcgctggccctccctgaagcccaaacaggaccgtccccgagactcgggagcctcggctctaaggcttccaacctgacccggtaaacaaacgacgcgatgtgcagcaaaattggtgt

SEQ ID NO: 58147 - DNA, 2846 bp, Homo sapiens
ggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggccaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactgaacactcctggcatgtgcactcctctggaaggcaggtctcagaaggcacaagtgccggtatggtggccttggggaa

SEQ ID NO: 58148 - DNA, 2771 bp, Homo sapiens
ggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggccaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactga

SEQ ID NO: 58149 - DNA, 268 bp, Homo sapiens
tggaggtctctctgcccctggtcctgggcaggccctttctcccctgctgctctccctttccccctcccagggctcacgccccctcagaatggaggctgctgaccccgggtcccctgccctgcagaacctgtaccgactggaaggggaaggctttcctagcattcctttgctcatcgaccacctactgagcacccagcagcccctcaccaagaagagtggtgttgtcctgcacagggctgtgcccaaggtgagcctgcacccagcctgg

SEQ ID NO: 58150 - DNA, 412 bp, Homo sapiens
atcggaggcaactttccctgcctgccccatgtgctctctaggttccccagcgagggtcaaactcccagagagcctgggtgaggggtccgaacacgggggcccctcacccaggggtaggaagcagaatgggtaggaagcggagaagagaactgcgggactgggaaggccgtggtaggagcccaagaccgtttcaggggaactttggcgaagtgttcagcggacgcctgcgagccgacaacaccctggtggcggtgaagtcttgtcgagagacgctcccacctgacctcaaggccaagtttctacaggaagcgaggtgggtgataaactaatgatcaccacgggtcccgcatacacagaggttacactgcatggcacagtgtgaagtgcttgaccaccgtggtggtgtttagtc

SEQ ID NO: 58151 - DNA, 196 bp, Homo sapiens
atgagcccctgccctgtctcacccagggacctggctgctcggaactgcctggtgacagagaagaatgtcctgaagatcagtgactttgggatgtcccgagaggaagccgatggggtctatgcagcctcagggggcctcaggtgcggtccacttcacggggacttgtctgaggccccctgatgctggggtaccgaga

SEQ ID NO: 58152 - DNA, 2556 bp, Homo sapiens
gcacgaggggtgtccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggccaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactga

SEQ ID NO: 58153 - DNA, 296 bp, Homo sapiens
acacagttctccatttgaggcctccgcctcctgtcactgtgcacccagctgcctcctgggtactcgaccccggctggctgtggagcactcccaggctagtgggggaggcacaaggagaggcagctacgtccttactgaagcctactggtgagactgaggatgtgggtgccacctgtcccacatatcaggctcacctgcatttacctgcatttgaattttgcactaggacaagtcactcctctctgagcctgtttcttcttctataaaatgggttgtcttgaggattaggtgagagt

SEQ ID NO: 58154 - DNA, 299 bp, Homo sapiens
cacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaa

SEQ ID NO: 58155 - DNA, 565 bp, Homo sapiens
ccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacgttgtacccggtaggttgttcttcaccccttgttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcctccagctccaatcatgttgctgcaaaggacatgacttgattctttttatgcctgcatagtattccatggtgcatatgtaccacattttctttatctaatcaactgttgatggacagttaggttagttccatgactttgctattatataataaatggtgctgtgatgaaaaaaaaa

SEQ ID NO: 58156 - DNA, 580 bp, Homo sapiens
tgaggcagcagagttcacctcagcctcctgagtagctgggattactgtcatgcgccactacacctggctaatttttgtattttcagtagagaccaggtttcaccatgttgcccaggctggtctcgaactcctgatctcaggtgatctgcctaccttggcttcccaaagtgctaggattacagacctgaactaccacacgcggcccctccctccactttggactgcacatgcctcctttattcacttaagagaaaggtgaggaacaaagaaaggctaaaagacacgtcacattattaataatcttggctagttgtaacaaagtaaaataaaatgtctcaataaatttttaaatctttgttgcttggcttgtctcattttagcattgagaatcaagcttaaatatccaagtaatcagttataagaatacacaggaaataatataacacttttattcccagaataaaaatagaatgctttcagtcccgggagctccttttctgtttttcattaaatttttttgatgttgctgacacatcccatttaaacgtaatttttatttccttagatatttttgaataaa

SEQ ID NO: 58157 - DNA, 504 bp, Homo sapiens
ctgcttataatctgcccatggtaagcctgtgatctcattagtgagttgatagacatttacaaacagtcaaattgcctatcatctcatgcattgtggacattctgtcagatccttagctcaaattaggcttcatattcatttagatatattgtgattctgccttggaaaatctttcaacaggcagacttagatttgatttatttcagtaaaacatcttctactttgtggcttgtttcatttctattccactataatgatatttccctgaataacatagcaagtgatttagtggttttgtaaacctgcactatgtaataatgcatgatttggggtacaatatgctggattttatcacttggcaaaatgagagaaatgagacagaagtcaagaatttccatgcatttctttcaaaatttaaatgatgagttttccaattaaattttcttgtgatatagtctcacgttaatgctgaaatgttaaaaaaagaagactctttaacactga

SEQ ID NO: 58158 - DNA, 312 bp, Homo sapiens
gtctttcctagtttggagatgaagtgggggtgtgggctcccctgttttcccaaagcctctttggagaggaaggtgctctaaggctatgtgtggtatgtagtcgggtttctggggaagagaaggctttgaggctagagtgtctgtcccatcccccatcatttctaactagccccccagctctaggagttatctttctccgaaggccccaaatgattattcagtctgggaggggaagaaggtgaatgaaatataagaacttggggagggaaaggatgtctcttactggctacacccacaaacgtgcatatttgt

SEQ ID NO: 58159 - DNA, 385 bp, Homo sapiens
caatgattcccaaacttgaccatgtcctagacctcatccccagagtttctgatccaggatgtctggggtgaggcccaagaatttgcattttcagcaagtacgcaggtgatgctggtgctgccagtcccaggaccacagtaggaaccactgctttagtgtgtggacaggatgctaggtgaaatgttccttttggaggcagggaggacattcaggaaacagatgaggacaaagaaggagagaaacagaagtttgtgcccacttcctcttgctcccagcttgtggcaacccttgtgttttcccactttccctgcaccaacaaaacctgacaaaatctgcttagagaagagtctcctggcatcagaattgtactttacttaaaggcaaa

SEQ ID NO: 58160 - DNA, 323 bp, Homo sapiens
tccccatatcctcaacaacacttgttattttccattttttaataatagtcatcatagtaagtgtgaagtgatagcttggagttttaatttgtatgtctccattgactaatgatgttgacatcttttcaagtgcttattggccatttgtttatcttctttggagaaatgtttattcaagccttttgtccattgtaagatggacaaaaatggttgtctttttgttgtttgtttacaaccattttgttttaaaatgttttgtctttttgttgttgaattgtagaagttttttatatactttgggtattaaaccttaacatatatac

SEQ ID NO: 58161 - DNA, 1070 bp, Homo sapiens
ttatttactctgaaacatttaatgctaactcatttatattttgtgaaacgatgagtgtatggctggagttcgggtggtagggtggagaggcttgcattcctgtgccatttccccattcccaccagtgcccaactggacagtgattagtatcccctctccagactcaacgtcttcaacattttcgtttttctttctcacagttgagaaaatctaagaggctctcgacaacatggcatgcatctgtgaaaatcccactgcccttatattagtcttcattgaccatataaaaaatctttgactcaaatatatgaaaagcagtcagcatttccctttggccactggaaagcttgaggctgaataatatcagttctgcaaagtgctggcaatgcatcctaatgaattttccatgatgcatgtagtgccttgtacacaatgatcaagaaatgcttcattgaatcagaaattaatctattttataaagtgcttacattgaatctctttccatacagcctcatttcttgccccccttgagccttttgttcctgttagaatgaactgtgcaattcctaaagtccctgtgctctttcatacctctgtgttttagctcgatgtgtctctgtctgaagcagcttggaatccccttcttaatttttaagacttaaggtcacttctatgatgaccctattcctcatttcttaggtggaaagacccctctctcctttgaagccctaacagtgctctgaatagaatcaatgccttttttgtttccacatatatcatcctccactgctactgtgaactctgtaaagtcagaacatgtgtgactgacctttacatctgcagtgccaggtgtgtagttggtatctagtgagtggttttagtgaatgaatatactgcagtcatactgagataactggagggatcaataggacttactgccatacatttaaatccgatctcattctctttttgccagttaacaggttacttcaatctgttttataaataatctgtgtatcaagagtaaataagtacagtttcgttttctctgtttctagaaggcatttcag

SEQ ID NO: 58162 - DNA, 414 bp, Homo sapiens
acatgctgggttctgtgttagcttctagggataagtcagtgaagacatttattttaccaaatagctcatcatgtagtagagattacagacctgtaatcaagttacaattacagtatgaaaaggtctgtgaaggaataagtaccaggtataatgaaatcaaagggaatgcccctaactcatttctgtggcaggaggtgatcagagagggctttaaagaggaaggaatgtttaagatgagccctaaaaggtcatccagagttaattatgtgaaaagggaggaacaatatagacaaagtcctggggttgttgcacaaggttcagcatgactggaatgtagactgtgaagtgaaaaagtaatgacattaaagactgaattcacagagaggggctaaattattgactttgtaaacagtg

SEQ ID NO: 58163 - DNA, 150 bp, Homo sapiens
aaacaatacattcatatatcaaaattggccccaaattccttatcatcatcatcaacagtctagaaatgaaatgacacataatataaaactttcctgtttataactaaaagatttatgaaactgttttttataaatgcctttttttttttt

SEQ ID NO: 58164 - DNA, 291 bp, Homo sapiens
cacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaa

SEQ ID NO: 58165 - DNA, 563 bp, Homo sapiens
gggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttct

SEQ ID NO: 58166 - DNA, 718 bp, Homo sapiens
tctaatttggcgggggcgggaagggcggttctggaaggaaaatgagatggaagtgatgatgcaggcaacttaattaagagactgggcgcaaaacccaggtgtgtgtctgtgttggttttgtggtgtggaggcagcagggggagggaggaaacactcagttttcctgctaccaggtctagagaattgtatctcagttccctgtaggggtggggccctcccattccttcagggttgggccaggtcccctgggcccagggtcctttcattcacaaaggactgaaaatggagacagctgacattatctgaaggctgaacaatagccatagagctccactgcctggtatcatagcattgagccctgaacacctttcaacttggtaccattatcacaccctctgtggtaacccacaaagaatccaatcttcccctaattctcaacaagagcacaaggatgttacattgtactttgagggttaatagcatttatttatttgtttaacatacacatttaaaatatatcaatttctgtgtgtggttttttttttttttttttttgagatggagtcttgatctgtcgcccaggctggagtgcagtggcgccatctcggttcactgcaacctctgcctcccaggttcaagcgattctcccgccccagcctcctgaacaggtgggattacaggcgcccgccaccacacctggctaatttttatattttta

SEQ ID NO: 58167 - DNA, 758 bp, Homo sapiens
agctcaaattccatttgtacttaaggttacgtaacagctcatagtgtaatagctttggcccgtgtccagtgagcctgtagatattggcggctttgcgtgcttaaaaggcccccatcaatcagtcatgatgcctggtcctacacccagttgccatgtttgtttaagccggctttggaggttgtataaatagtgttagcaacctgctctcccacccttggtgataaatggcacctttaaaaatcctttggcacattcttaggatgcgaaggagtagaactggatccattgacatctttggtggttatcagcctccttctgcatatgttcttgtggcatctccaggagggaagtgtggagggtgcctggggcatccgtaccgccctggcttcttgggcctctgcagcctctgcctgtctgaatcagctagtggagtatcctgcctcgtggaaactggcaagggctgcacaggggctcccaaatgaaactgtgactcaggactggacaagcgaattcgagttcacacagaatggaaaggtgtactttttcccctttaaaaaaaaaaaacacaaagattgctacaacatgttggcattgattcatgcagtcactttttgttctgtacaaacagtggccttggggtagcaggaagagcaatgggcaaaggacacaacctcagtgcaaaagccctagctcccttggaccacagttgcatatctagaaaattaagaaataacttcctcttgttgtgaggttccggc

SEQ ID NO: 58168 - DNA, 272 bp, Homo sapiens
gtttgtgctacatggagcaggcttctctcttctttctctctccccaggttctatctcctcccaggagatcacagaggctctggcctcccctctctggcccatttattatggggtctgttttgtccatttgggccttcctgcgcagctgttgcataggcctcgtctccccagatggactgggcccttgcatgtgattggtccttgggcagataccttgtgatgtaaagcaggactcatgatttgtgtttctttcatgtggcccttggtgcttt

SEQ ID NO: 58169 - DNA, 576 bp, Homo sapiens
taaacaagtaaacacaccaaatattctacctagtcattccacccctacatgcttacccaagagaaataaaaacatgtccacagaaagattgtatgtgaatgttcatagctggtttatttgtcattttaattgcgaaaaaccagaaacagcacaaatttgcatcagcaggtgaatggataagcaagtggtaggatatctacacaaaggaatactacgcagcagtacaacagaatgaactactgatagacagaatgacatggacgaacctcaaaataatgccgaatgaaataaatctatcaaaaaagaatacatactgtatgattccattcacatacaattctagaagacacaaatctgaagtgacacaaatcagatcagtagttgtctggagataggaaagaggaaaaagagagggattccaaaggagtacaaggaaacgtcagagggtgatggatagatttattttttattgtagtgatggatttacaggtatatagacatgtcaaaactgtacattgtacaatttaaatatgtgtagtttattgtacatcaaccatacctcaataaaatagtaaa

SEQ ID NO: 58170 - DNA, 631 bp, Homo sapiens
agcgggtaataaggagtagcccctgtgaggtcaggtacacagtaaagagggtaaatagaatccttgggaacttctgtttcagtctgaggaatgcttggatttgtcaaaagaatggagctttgtaggaaacaggcacaaagacgcaaacccagggcttaacctgctagaaaatgcatggaatgtgaacacaagttaattatttcaaaatgtttttcagatgttatttaaatagtaatatatacattgatttttcataatttatcaaagcctgtggtacgcactgaattttctttgtcacatagttttgaatttcacagccttctgcattgcatacacttgaactggacatcaggggaagctgcttgagagttctcaattactttcttaaacagtgttttctgaaggcgtgtgtcatgatacaactgtgaattctaccttagggactctggttaaactattggtgaggagctcgagtggtttgtatagaccccagatttttgtttactttaatgtattccacaaaacccatcctggtttttgttagtttgttttgtttttaatctttttttttccttctctacttatttaaattgccactggaataaatgtgccttttgaagcaaagtccaaa

SEQ ID NO: 58171 - DNA, 418 bp, Homo sapiens
caaagtggagtacttggtggcagaaagtgtcagataaccaagtccagagtgttctgatcatgtaggtggaaaccactcatatttcttgtcacctgcctagacgaaaagaccagggttgtttatggacaaggtcagagtggaacttgtgatgcacagatggaagtttattgtgctttgtcttctatcatattggcatttgcacatctccagcttccatgtgcccctgtcagtctgtgggagtgaaatagttgcaaagtatttaatataagatgcctttctgttcagtcctggcagttatacagcttggttttttcacctggccaagtcagtccaggcttttgatctatctgtatgtaaccttcggtgtgtgcttgcttaatgagaggagcaggtgagctatgccagctcacacagggct

SEQ ID NO: 58172 - DNA, 373 bp, Homo sapiens
cgggatttcattatgttggccgggctggtctcgaactcctgacctcatgatccgcccgcctcggcctcccagggtgctgggattgcaggcgtgagccactgcgcccggcaaagctgagttttaaactgttccttccttcattcagacacttactgagccctagtaagaagccacccatgttctaggccaggggttgacaaactttctctaaagggtcagacagtgaatatgttagcctttataggccacatacagtctctatcactactaccaccaataataataataattctttctcattttctcattcctcttctccttctttacagctcttaaaaaatattaaaaaaaaaaacaaaacaaacaaaacaaa

SEQ ID NO: 58173 - DNA, 464 bp, Homo sapiens
  misc_feature (13)..(13): n is a, c, g, or t
  misc_feature (28)..(28): n is a, c, g, or t
  misc_feature (85)..(85): n is a, c, g, or t
aaaccaattggancactgccctcctcantgtttaaacaacctcctccccttgccaaaggcctgttgttatgtcctggggtaaganggaccatgggggggtcccctaagcatgccagccatgccacctgtccagagcatcctgtagcccacagccccggcagaggaaggtagggacccatgcgggggcaaaacacaacaaaaaccaaaccaacaaggaagtacaaagaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 58174 - DNA, 2542 bp, Homo sapiens
agccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatagatttgaggtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 58175 - DNA, 2679 bp, Homo sapiens
agccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatagatttgaggtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattccaacaacaccacacaacccacaaaaacacactacaaacaaacaaccacacacaatcacgaaccacaagcatccaaccccacaaccacacacccaaacaacaaacgggcgcaaaaatacagccgagacacaacacacag

SEQ ID NO: 58176 - DNA, 301 bp, Homo sapiens
cagatgtgggtggaggaggtcatggagaagttcatgaggtagggctggcagagctgtggggatggcgttccaggggaaccgagaagaggtgggggaggaaccagcttgcctgtactttgtgaaaaaggaaaaggtccttgctgaattgagccagcacaattcagtgcaggctcagagcaagcccctggcatgaggaatggccgtatttggtccagtaatggtctccctagtattgtcacattgactctcattttcttaccctctactacactgatactaataaaagcatgggttgcaaact

SEQ ID NO: 58177 - DNA, 2365 bp, Homo sapiens
agccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatagatttgaggtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 58178 - DNA, 2190 bp, Homo sapiens
agccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatagatttgaggtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 58179 - DNA, 651 bp, Homo sapiens
gtgaatcctgagggttagagcatccaccaggtgccctaggtaagggccagccactctgggaggcagcccggggcactcactgtcctctcagtagtaaatgaaatcactcaggccatgtctgctacccagagagcctgagtgtcctcaaatgcttgttctgcctctccatccactcctgcagacacctcagtggctgcatcccaaaccgctgaactttgcttctctttctccaacccccaattccacccacatcccaaaactgctctgccccctattcccatctcagctgagggtactatcatccaccctgtggccacatccaggaatgtgtgtatcacctgggctctgaggatgacatcagctcttctaagtcaacagaatgtcgggtctgttctaaaagtctcatctgacaaggagatctttaaggctttactcccttaaaggctttactcccatcatgatggggatttcagtgtcattctgtctttttcttcggaatgattcctgggactcgccttgtttgcaacatgtgcattgaaatatcttttcaacataactttgttcttaattgtgtttacttcctttctctgtgaatctcagtgattcctggaagctgtggttggtgggggatggggtgggaggactttggta

SEQ ID NO: 58180 - DNA, 666 bp, Homo sapiens
gtgaatcctgagggttagagcatccaccaggtgccctaggtaagggccagccactctgggaggcagcccggggcactcactgtcctctcagtagtaaatgaaatcactcaggccatgtctgctacccagagagcctgagtgtcctcaaatgcttgttctgcctctccatccactcctgcagacacctcagtggctgcatcccaaaccgctgaactttgcttctctttctccaacccccaattccacccacatcccaaaactgctctgccccctattcccatctcagctgagggtactatcatccaccctgtggccacatccaggaatgtgtgtatcacctgggctctgaggatgacatcagctcttctaagtcaacagaatgtcgggtctgttctaaaagtctcatctgacaaggagatctttaaggctttactcccttaaaggctttactcccatcatgatgggataaccatcatgatggatttcagtgtcattctgtctttttcttcggaatgattcctgggactcgccttgtttgcaacatgtgcattgaaatatcttttcaacataactttgttcttaattgtgtttacttcctttctctgtgaatctcagtgattcctggaagctgtggttggtgggggatggggtgggaggactttggta

SEQ ID NO: 58181 - DNA, 262 bp, Homo sapiens
ggaccttgacccacatccatgttgaggaatgtcctctatgtcaaggtcagggaacagcacccacagagggtgcctctgggtccctctctgctcaactccctctctcttggttcctgcgaggctcatagggttgcagggcccagcagaaggactgagtcttcctcctggacttctggtcctggtaggctgtgccttcatgtctctcctgtcacctgcactgtaaggaactcattatgacaaacgcataaagaatatggctctg

SEQ ID NO: 58182 - DNA, 294 bp, Homo sapiens
acacacacacacacacagtgacatgcacacacagacttagctgcaacagtgacatgcccacaaatgctaaccacaaacatacatgctgggtgacacccaaagctgtgaacatacacatagcctgatacaggcgcagggacacattcacttgcacacacatataccaatatgcatgtacagtgatagacatacaccggcacacacatgtgacaaacgtgtcgctcaccaaaacaagcatgcactcacacgctcaccccaggcactcacacctcagtgtacaatacccactcctcg

SEQ ID NO: 58183 - DNA, 729 bp, Homo sapiens
ggatcagcctggatgtgtcaaacactgcctgccaggcttagagctcagtgcatttcttcccttttattcctgctgatgggattgctggccatgaccggtgagaggaatcaaggaacccattactatgagttctcaggattcatcttcaaatctcaaatgatgtggtcaattaaaccaaattaaaaacaagctcttgttaaaagcaagttaaaaacaagctcttgaccttgagaagaaatgattggtattaggaagactgttgagctgatactgcccttcattcattctctaccctggtgcttggatacaggagcaaagtaagaaaataatcacagctttattgagggctctatgagcaaggcttggtgaggatggaagagaatggagctatcagttgatgagaacctactaggtgttgagctccttacattcattgcctatttaaaactttctaacaacttcatgtgtaagcgttgtcccgatttaaaaaaaaaaatagatgtggaaactgaacctggagaaggtgtgtaatttgtccaaggttgcacaggcaaaggggcaaaattcagctttaaacccaggactgtttccacagctccaagttccctttattcatgggatttgtaagatggagcccctgccactgtagcatttataacttactttggagaataagattcctgaaagtacgtttaataaaaaaaaaagatgtccagctatgtacggcag

SEQ ID NO: 58184 - DNA, 859 bp, Homo sapiens
gaatgattctgtccaaagaggttaatcattaaaatgctcagaggagacctcagcaggcccttgaagaacacagcaatttaagaagtaaaaaggaggatgtaggggaatgttagtcagggtcaagccaaacattgaattcagcatggcaaatgaaatttactgtaagtggtctctgtgctgagatacatattactgtttgtgcaaatttagttccgttaacttttcccaaaacttcttcaccaccttatcttggagcttaattctaactctctctactatgtccatactatgggaatgtcttcaagataatattgtcttgttaaaattcggcttcagacttcaggacttttacattcttggatggggatctaaacaagacatgaaccaatcataaggaaatatggctccttctccattattttaaacaagaaaatattattgttattgtagctgtttgagagacaaggagattaaacttgctacggttaagaaatttgaaagcagatttttttagaggcagacaataaggaagagtgtttttggacatactttgctcaaacctttcctgtgtttgagtattccacccaaacagaactttctccattgagccatttgctgtcctgtcagctaaaaaataaaaaataaaaaaaacaataaaacaaaacaaaacaaagagcaaaaaccattttatcttcttgatactgtggcacttgatgtgcaacagagagactacattcttgcaatcggtcagaagcagaacttgaccaatatgaaacaatacatatcctaagaaaacaacatgcacagataatttgcagaaagtttagaacaacaacaataaaatattttaatttgctct

SEQ ID NO: 58185 - DNA, 283 bp, Homo sapiens
aaaagggggaagaaggaggagagaagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58186 - DNA, 699 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctaagtattcacatacacacagaaaatacgggtgtgaaaagaagaattttctgtacaaattaagctgcatactttgggtaaaagtgataaaaggctgtagtgccaataaaagctgcttttaaaataagtgtggctcggaatattataagatattggggaacaatacaaatcaagaaaatttctgggcttagagtgcttcatagatttatttaggactctcccccttgcccctcg

SEQ ID NO: 58187 - DNA, 2110 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58188 - DNA, 1847 bp, Homo sapiens
ctcctagccctcttacctcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58189 - DNA, 2149 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgttaaagaagaagagacagggaaagagaatagcaggggaata

SEQ ID NO: 58190 - DNA, 1966 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatggggcatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58191 - DNA, 1906 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaagcatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58192 - DNA, 1752 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 58193 - DNA, 2032 bp, Homo sapiens
  misc_feature (1765)..(1765): n is a, c, g, or t
  misc_feature (1779)..(1779): n is a, c, g, or t
  misc_feature (1816)..(1816): n is a, c, g, or t
  misc_feature (1838)..(1838): n is a, c, g, or t
  misc_feature (1850)..(1850): n is a, c, g, or t
  misc_feature (1937)..(1937): n is a, c, g, or t
  misc_feature (1942)..(1942): n is a, c, g, or t
  misc_feature (2013)..(2013): n is a, c, g, or t
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatttttcctctttgttcacattcctttcctatccccctcactccgcncatcccccgttctncccttcccctttactcactctctccccctgcctacangaaatttatccccccacccttncccttctcttgncccttctcccctccccatttccactacgctcatttttaatttttaaaattttttttccctctttcctcttccatgcttccaatttcncattntacttcactcttcctgttctctccctcctctccctccttctctccaccccttctctctatattcactctcnccttccactctttctactc

SEQ ID NO: 58194 - DNA, 764 bp, Homo sapiens
tgattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctggcccggcctggggcccgcgcggatgtgggcacggtgcatagtgggggtgaagcgcaacacgcgggtgatgaacagccgtggcatctggctctcctacggttgctggccatcggtctcctcccacatcgtgctgttgagcatcccgtttgtgagtgtccctgtcgtctggaccctcaccaacctcattcacaacatgggcatgtatatcttcctgcacacggtgacggggacaccttggagacccggacaggcaagggaggtgtaaccatgggagcgaggtatgggccagtcaggct

SEQ ID NO: 58195 - DNA, 351 bp, Homo sapiens
  misc_feature (234)..(234): n is a, c, g, or t
  misc_feature (237)..(237): n is a, c, g, or t
  misc_feature (285)..(285): n is a, c, g, or t
aacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatggtgagagcctgtctgctgcctgcccctgcccctgcccnctngccctgtgggctgccctttggcagggctgagggataggaggagcctgntcgggcctggcccaggtgtcagggtgatgtactgacgacatctgcctccagagcccaggcctagcc

SEQ ID NO: 58196 - DNA, 1301 bp, Homo sapiens
  misc_feature (838)..(838): n is a, c, g, or t
tcctggagcagtgacattgcaggatattttctcctcctccagccacactttgtcaccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaaanttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttccc

SEQ ID NO: 58197 - DNA, 585 bp, Homo sapiens
  misc_feature (485)..(485): n is a, c, g, or t
  misc_feature (505)..(505): n is a, c, g, or t
  misc_feature (536)..(536): n is a, c, g, or t
  misc_feature (542)..(542): n is a, c, g, or t
  misc_feature (554)..(554): n is a, c, g, or t
  misc_feature (557)..(558): n is a, c, g, or t
caacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctnggggatacgacacatgcccntgatgagaagcagaacgtggtgacctttcangaacangggcatggctgnggnnccctcgtcatcaggtgcatagcaagtg

SEQ ID NO: 58198 - DNA, 453 bp, Homo sapiens
tttcagcatgccctcctcactaagcttagccatttctagattctgatttagtgtgagagaatgcaagtcttcctttcatttgaactgttagcggccattgtaggattgctaattgtcctaatttcagtattgctgtgtctcagggaataggtaggcccaagaaaaggaaaagagtcgggaagcgctcatcggtggagcagtcagaacacacacaacattgatcaattacgttcgtcatcttctctgggtggagttcctgttacgcccaaaacattacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttccc

SEQ ID NO: 58199 - DNA, 1359 bp, Homo sapiens
  misc_feature (896)..(896): n is a, c, g, or t
tcctggagcagtgacattgcaggatattttctcctcctccagccacactttgtcaccaactgctgccaactcgccaccactgctgccgacctcgcaaccactgctttgtctctgaaaactgggcttgacctcctcggctcaagtgatcctcccacctcggcctcggaactacaggtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaaanttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttccc

SEQ ID NO: 58200 - DNA, 1387 bp, Homo sapiens
  misc_feature (924)..(924): n is a, c, g, or t
tcctggagcagtgacattgcaggatattttctcctcctccagccacactttgtcaccaactgctgccaactcgccaccactgctgccgacctcgcaaccactgctttgtctctgaatagagacagggtttccttatgttggcagaactgggcttgacctcctcggctcaagtgatcctcccacctcggcctcggaactacaggtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaaanttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttccc

SEQ ID NO: 58201 - DNA, 897 bp, Homo sapiens
  misc_feature (797)..(797): n is a, c, g, or t
  misc_feature (817)..(817): n is a, c, g, or t
  misc_feature (848)..(848): n is a, c, g, or t
  misc_feature (854)..(854): n is a, c, g, or t
  misc_feature (866)..(866): n is a, c, g, or t
  misc_feature (869)..(870): n is a, c, g, or t
tcctggagcagtgacattgcaggatattttctcctcctccagccacactttgtcaccaactgctgccaactcgccaccactgctgccgacctcgcaaccactgctttgtctctgaatagagacagggtttccttatgttggcagaactgggcttgacctcctcggctcaagtgatcctcccacctcggcctcggaactacaggtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctnggggatacgacacatgcccntgatgagaagcagaacgtggtgacctttcangaacangggcatggctgnggnnccctcgtcatcaggtgcatagcaagtg

SEQ ID NO: 58202 - DNA, 315 bp, Homo sapiens
cggtggaactgattttctcactgactatagatgttgagcccattaatgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgta

SEQ ID NO: 58203 - DNA, 432 bp, Homo sapiens
atggaggactggggaaactaccaattctagacctagtttcttatttagatcccaaaatatgccgcacacaccaaggctcctgggagccctttctagccagaaataagtataatttgtggatacttgtcaaatgaaagatcactaggctaaagctaaagaaagctgaagagaaactaatgttctagatcatgctcactagcaaggagggaaaattttactagttgatagattcataaatctttgtcagcacaaaatctgacaagacattactgtcaatgatgacaaattatttggctctataaatctcttcccctttttaacaaatccagtgtgcaatcggaaaagctctttaggacatcctgcttataggaaacggcctacgtgacctgttaaatctcaccctacttccactttcagtgatgcacttaggat

SEQ ID NO: 58204 - DNA, 463 bp, Homo sapiens
aaaagaattgtaataatacatgccccaacaccccatttcagctttttttctcatgatataatgataaatctcctcacctgtgtggcacatgagagaacttgaaacattttcttagatatcatcttacctcttcacacaaaccttctgaggttattggagcatccattcacaagtatttgtgcattttactgaggacaagtcagctcagagtagtctggggctgagctggaacttgtgtctgggctttcaactcaaaagccagtgttttctccattcctgcctcaatctggggaagagaaaactcatgattctttgcagatcgcctaaatttccccttaatttggcaacttttggctcactccgtcatcagtcctggaggagcccttcacactgatcccatgaatggccctcaacacatgcacgagcaaggagcaagcgttcgacaagtgctctcgcagtactc

SEQ ID NO: 58205 - DNA, 451 bp, Homo sapiens
ataaaatgtacttttctctagtaacaatttttgtcttaaagtctactttgtccaaaatattagtagagctactctagctgccttttgcttttatggaagagttgattttcagaggcactgataaccattctggaaagcagaacctctaactacttcttacaactcttagagatagttgtcccggttttaggtctgctttctcccccatttccaaagttaccttttggagactccgtaatgctgcgtagctttgctgcttttattgctgcttaggatcagctttcttgggtcggctaagtcattacaatgagtccttctgctttccggtttcctaaattttgtaaccgttaactccttttctattttctttttcttttgagtttattactttttaaaaactcttcactattatatcaatggcttttccaaggaaacaaaattcaagagtgat

SEQ ID NO: 58206 - DNA, 2191 bp, Homo sapiens
  misc_feature (2184)..(2186): n is a, c, g, or t
  misc_feature (2189)..(2191): n is a, c, g, or t
gaaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaannnaannn

SEQ ID NO: 58207 - DNA, 2086 bp, Homo sapiens
gaaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaattctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaactaggcgccatacgcgaacttagaaccggacctggacaagggattgagaagtctttccccctcatactggctat

SEQ ID NO: 58208 - DNA, 2648 bp, Homo sapiens
  misc_feature (2641)..(2643): n is a, c, g, or t
  misc_feature (2646)..(2648): n is a, c, g, or t
ggcacgaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggatcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaannnaannn

SEQ ID NO: 58209 - DNA, 428 bp, Homo sapiens
cagctacttgggaggctgaagcaggagaattgcttgaacctgggaggcggaggttgcagtgagcctagatcacgccactgcactccggcctgggcaacagagcaagactccatcttaaaaaactaaaaaaaaataaaaaatacaggccaggcgcaatagctcacgcctgtaatcaatgctcatctttccagaattgggaggctgagccgggcagatcacctgaggtcaggggttcgaaaacagcctgaccaacatggagaaaccccgtctctactaaaaaaatacaaaattagcggggtgtggtggcacatgcctgtaatcccagctacttgggaggctgaggcaggagaatcgcttgaacccgggagacagaggttgcggtgagccaagcccccttgcgccattgcactccagcctgggcaacaaga

SEQ ID NO: 58210 - DNA, 791 bp, Homo sapiens
ggtgttagtggcttggttggccagcagcttgctgttactgcaggaccctcctgggcagaggagaccctccagggaaatacacactattttatgtgctggttttgggcctaacgcctcatgggcattcttagccctgggagaccagtgtatgagctgggattgcctcacactaagaatagcaggaacccctagaagtctagggccattgtggctttggggagcccaggctccttgtttttttctgctgtgttattctgaaggcagctcaggatcccaggatactgtgatagtccttcacctccagcctcagtccaggcagggacaagcaacgcacctgcatcgggaaagcaaaactcagcaattgtggtcgacctccgcttgcagcctattggccagaggcaggtcacgtgaccactaggtgggtggtaatctggaaagcgttgggcgcactgctgtccctggacaaaatccagattcttgttagtgaggcagatgagaagaacggatgctggcaggcaaagagcagtgtctgtcacagctcagctgggctgtggcctccagctgttcacagggatattggggctttggcattcaaggggctcaaaggggaaccccctggggataggtctttgtttttcttttcctgtagggcagtggtattgaaccttggttgtgggttagaatcacctagagaacagtgagggaaaaagtgtctgtgcctcacctctgggtcaggagtgaggctaggcaaaggaatactttaaagaacttccctgtgattaaaaagaaaa

SEQ ID NO: 58211 - DNA, 430 bp, Homo sapiens
aatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatactctcatgatgaatgtcaggatgctctaaacattctcccaggtagcctctattttccttgtg

SEQ ID NO: 58212 - DNA, 2222 bp, Homo sapiens
ctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgct

SEQ ID NO: 58213 - DNA, 1421 bp, Homo sapiens
ttgggagaactattctctttatgaacttgcaattacacaaactggaccctcaattctctttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgct

SEQ ID NO: 58214 - DNA, 207 bp, Homo sapiens
ctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttg

SEQ ID NO: 58215 - DNA, 253 bp, Homo sapiens
tactatattgtttctgttatcgaattataaatacataatccctgtgagcctagttcatttatgatgtaattgattctttgtgaacagcagaacttaaactcatattgctgctacacaagaataagaagccaggcatggtggtgcacacctgtagttccagctacttgggaggctgaggcgagaggatcgttggagctcgggaatttgagaccagcctaagcaatataacgagactctgtcactttaaaaagaa

SEQ ID NO: 58216 - DNA, 1693 bp, Homo sapiens
agggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgcatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatac

SEQ ID NO: 58217 - DNA, 507 bp, Homo sapiens
gaattgatccccttaccattatgtaatggccttctttgtctcttttgatctctgctggtttaaagtctgttttatcagagactaggattgcaacccctgccttttgttttccatttgcttggtagatcttcctccatccctttattttgagcctgtgtgtgtctctgcatatgagatgggtctccagtttttctaggatggacactttcttttataaagtgtctcttctgagaagaatttgcattcaattccctcaggtgcctacaggcaccaccaacataagcccacctaaactgcatttttgtcttgattttggggggatcacactagtagtataaatttaggctctaacctgattaggtaggggctttgagtaaagaattatcaggaaagacttttcatttgtttccactctaactaaagccaaaaccaagataggtacttaataacagtctccctgagtggtagggcaacttttgttcccctcttttggcaaccaagagtgtc

SEQ ID NO: 58218 - DNA, 577 bp, Homo sapiens
  misc_feature (544)..(544): n is a, c, g, or t
caggttatggaactttattaaagcagcctgaactgctgaagatggaaattgatcatgagaagtgggagtgctgttattataaatacctaaaacaaagtgaaaatggttttgggctcagtgattggcagagattgatgaggttttatgcaaaatgctagattactgtggaaaaaatttaaaagccaattctcgtgagggctcggaaagaaatatagaagaaaacgctgtcttctcagaaaataattaaataatcatgaacagaatattgataaaatatggacagtaaaggtcattctgttggagtctcaaatggaaatgaatatgttattggaaaatggagcaaaagcaatccatgttgaaaagtggaaacaaacttttttgaattgtattcatgctcttgtgttttgcggaaggtggaacttgtgtgcagtgaaattggacatttaacccagcagatttctcagcaacatgtagaagcagcagcttggttccttctgaatctgtagagtcaaatgtagaaaaagaaaaaggtttgaagatggantggttaaggaaaaagtaaccataatttaagatc

SEQ ID NO: 58219 - DNA, 472 bp, Homo sapiens
taatctgatatatttacttacatccaaatctaaatttctgcattaaaaaaaccataatttattgtaagcaaaattaaaagacaacttcaaggttggagaaagcatgaaacacaggaaacacagggttaacattgctaatctgcatattgccccaatcaattagttataaaatgacaatacaacaggaaaaagcaggcaaatgatattatagtagaattttcaccacatctgtttttcttccctgtaagagaaaaatgctttaccaccctggtgagctcagacatggccatatgatttggttgggtcaatgaagtatgtcacaagcagacactttaagatttatgttttgatttgttgtgttctgtttaccttattctgcagcaaccagtgatattctgaatactatctgctcccaaccaacccaggattaaaatacaatgtgagaattaaacttttgttttaaaccactgaa

SEQ ID NO: 58220 - DNA, 365 bp, Homo sapiens
ggtacatgtgcacaacgtgcgggtttgttacatatgtatacatatgccatgttagtgtgctgcacccattaactcgtcatttagcattaggtatatctcctaatgctatccctcctccctccccctacgccacaacagtccctggtgtgtgatgttccccttcctgtgtccatgtgttctcattattcaattcccacctacgagtgagaacatgctgtgtttggttttttgtccttgcgatagccagatgcagctactcttaatgtgcatattttcatcctagaacattggagagttcctgtaaagccttgtgttccaggaggaaggagatcctgacccttctgctgatggcagcagtcacgggg

SEQ ID NO: 58221 - DNA, 306 bp, Homo sapiens
  misc_feature (4)..(5): n is a, c, g, or t
  misc_feature (59)..(59): n is a, c, g, or t
  misc_feature (130)..(130): n is a, c, g, or t
  misc_feature (304)..(304): n is a, c, g, or t
  misc_feature (306)..(306): n is a, c, g, or t
agtnngctaggggactgggatttctctgattaaatacttaatgttatcagcacatggtntaggtgcaggcaaactaccatgcattagccagtctggcccactacctgttttcaggaataaaactttgttngaatacagttacatgctttgttaatatactgtgtatggttactttcatgctacatcagagttcaatagatgtgacagagaccacctggcctgcaaaaccagaaatatttcctagctggccctttataggaaacatttactgaccacggacttatactattgttatgctagctcncn

SEQ ID NO: 58222 - DNA, 357 bp, Homo sapiens
acagacccccatccaggaaacatcctgagcactaattgaaaagcattcaagggcttactgaatttgcattcacatctggagttttcaaggccactaagctgtggaaacttgacatcaatattcaaatagatgaaaagggaccttaagcatatccatcagggagtcaccgagatgataaaggcctgagaagcagtatgctcttgtccggcatttgtgtcctttgacgactgcaccatccacccaaattttgctgccttctttataggaagggccttttcctcatgtggtgggctgcccactgtttcttctctgtgcatttgctcatgtagtttgaccacaaggaatgcttttccttct

SEQ ID NO: 58223 - DNA, 476 bp, Homo sapiens
cttcattagcagttctagcttcttatgcatttgagagtaacaaatcgaattaaatagtagtttttccttgttattttagattggcatgtgccacccactgcatagtgaactttcccagtgcgtttttaaaaaaacatttatttgtttatttttagagccaggatctttgctatgttgctatgctggatttgaactcgggctcaagtcctacctcagcctcctaagttagctgtgactacaggcgcgcaccaccacgcccggctaatttttttttaatgtattttttatagacagggttcttaccatgttgcctaggctggtcttgaactcttggacttaggcgatccgcctacctcggcctcccaaagtgctgggattacaggcctgagccaccgcggctggactgcgcccggcctagaagggcaattattttatagtaacttaatactaagacagctatcttgttagagcagtct

SEQ ID NO: 58224 - DNA, 414 bp, Homo sapiens
cttcattagcagttctagcttcttatgcatttgagagtaacaaatcgaattaaatagtagtttttccttgttattttagattggcatgtgccacccactgcatagtgaactttcccagtgcgtttttaaaaaaacatttatttgtttatttttagagccaggatctttgctatgttgctatgctggatttgaactcgggctcaagtcctacctcagcctcctaagttagctgtgactacaggcgtgtgctactgtgcccagcccagtgcttttattagtacagtcctatctgagtatttcatgaaattatttagtaaaatagaatttagattttttgtcttacatccacgtttttattctttcatacattgccctaaaatctcacgagttggtgtgatttctaaaagttaactt

SEQ ID NO: 58225 - DNA, 313 bp, Homo sapiens
  misc_feature (26)..(26): n is a, c, g, or t
  misc_feature (34)..(35): n is a, c, g, or t
  misc_feature (53)..(53): n is a, c, g, or t
  misc_feature (292)..(292): n is a, c, g, or t
gtgtgccaccacacctggctaatttntgtatttnnagtagagatagggttttnccacgtggatcaggctggtctcgaactccagacctcggttaacacagtttggttttatttggggagtggttggctatttaatccataattcaaatccactaatatcagtgagaaatgttcatacttagaatgacatatgaaaatacataaaaataaaaggcatttttaaactgaggcggatcttgcattgagccaagatcacgccactgcactccagcctgggcgacagaatgaggctncatctcaaaaaaaagggggga

SEQ ID NO: 58226 - DNA, 238 bp, Homo sapiens
gttagtcccatagaacagaatgtgttaaattaattggtgttcatgggagccagctcttaatctcaaaatcattaatataaaattttaactaactgtacatacaaaagattttggaaaaatcagtacagtcaaatccatggacattcttttattatgttattttatacatatagatgtacatatataaatctatatctacatctacctacccttctattcatctacccatctgtctatc

SEQ ID NO: 58227 - DNA, 598 bp, Homo sapiens
gtgacatagaggtatcctgccacaggaccctctgctccattcccaagtcctgactgggatatattctccttggttcctaaaattcatatctgttgattaatcccttaaactctgatggcttcctgattaaatgtagatcaaaatacccataagacaattttcagccaattaatttatggctgtgtgagtgctcactggcctttacaaatccgttctgaggacctataggatgccaaatgtcacaaaggttcactttccagttgccctctttgaaattcacatctcttctaggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 58228 - DNA, 386 bp, Homo sapiens
ataagggcggcatatgataatgtgggtgttctctgaggaagggtacaaatagtacaatattaatgaatttatgttcttagccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 58229 - DNA, 1378 bp, Homo sapiens
tcccctcaggtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 58230 - DNA, 1489 bp, Homo sapiens
tcccctcaggtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacacactagaatttctccagggtacaaagcaatctccagctccagccctttgcaggcatcagaaacaccaatagactacgattttccaattgcctaaacctactgatcacaaggactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 58231 - DNA, 601 bp, Homo sapiens
  misc_feature (15)..(16): n is a, c, g, or t
ggcaccgcgctaggnnagtggagatccggctttttagtttaaatggttcttgtataactcattttcttttaaaaagacgcgattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 58232 - DNA, 193 bp, Homo sapiens
ggaggctgaggtgagaggatcccttgagcccaggaagtcaaggttgcagcaaacagtgattgcaccactacactccagcctgggcaacacagcaagatcctgtctcaaaaaaaaaaaaaaatatcagtattgttttattaattgtaacaaacacactaaataaatgtaagatgccaacactaggggaaatagg

SEQ ID NO: 58233 - DNA, 4037 bp, Homo sapiens
  misc_feature (2425)..(2425): n is a, c, g, or t
aaagaacaagatttaaagaccaacaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatncagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaatgtaagatatataaataatgtttcttttatagatgtatgtttactccttttgatggatgatattagtcaatggtacctagtaatttgctgaaggattcaaatcacaatcatatttcataccgattccattatgttttcgtgaggtgcattatgttttcatgaggtgcacaaatcattaattatagtgcatattaatttgattaaattctcatttaatttctagtagtatttaaatgagtaaatgtgagtttttttctgccttgtaatttctaaataattaatatgttttaaggagaaataaaatatcacagtctaaaaataataaaaacattttctgagt

SEQ ID NO: 58234 - DNA, 1881 bp, Homo sapiens
  misc_feature (1018)..(1018): n is a, c, g, or t
gtgtgattggctgttgccatggatacgctttgtgtagcggctatgggcgctgtcttacaacaaagccaaggaatctcgctgctgagggcagttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaaggtattttgcttttgtttttcatgtatttttaaaatcagtagctacctctgaagaatattgatatttggattgtgttgcagattgagcttaatagtatgacttttaattactctctgatagaggaagaaattgactgtgaattaacagtatttaatatgaggtccttgattagtttttattgaaattcattggaaggtcagacacacttctgatcttgggggccantggagtctatgaatttcaagggtcatcatggatagcctgaaatttacaatataaattgttgtttttctttatatgcttctaaacattggaaaaagcaatgaaaaattcttgagtatgcattaaccttgctctgtggtctggcatatgacatgtaaaacatatttaaaagtagttcaaccatttagagtcagtctgcgccccaccttcataattaagctacttccttgaactggcaactttttggtgtgaagttttgtactgttttcatttctgtcgtatgtgttgttggtgttgttttccccctaggagatccacacaatcagatcatagtggtggtatatcggtattgagaaactggtggattttaggacaccacttgcaggtcatgagaaccttagaatatttggataacaggcatgactgacttctctatctttcatgattaaagttgatttatacattatccagaacttgctgggtttgagtgttgcatataaagaacattagcttgttcaacattttttaatcctccatgttgaggacatttcatttcttgactgtgtagaaaataaacacattaaaggctgggcgcggtggctcacgcctgtaatcccagcaccttgggaggccgagacgggtgtataacgaggtcaggagatcgagatcatcctggctaacacggtgaaaccccgtctctactaaaaatagagaaaattagccaggcatagtggcgggcgcctctagtcccagctacccgggaggctgaggcaggagaatggcgtgaacccgggaggcagaccttgcagtgagccaagatcgtgccactgcactccagcctgggcgacagagcaagactccgtctc

SEQ ID NO: 58235 - DNA, 4461 bp, Homo sapiens
  misc_feature (2849)..(2849): n is a, c, g, or t
gtgtgattggctgttgccatggatacgctttgtgtagcggctatgggcgctgtcttacaacaaagccaaggaatctcgctgctgagggcagttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatncagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaatgtaagatatataaataatgtttcttttatagatgtatgtttactccttttgatggatgatattagtcaatggtacctagtaatttgctgaaggattcaaatcacaatcatatttcataccgattccattatgttttcgtgaggtgcattatgttttcatgaggtgcacaaatcattaattatagtgcatattaatttgattaaattctcatttaatttctagtagtatttaaatgagtaaatgtgagtttttttctgccttgtaatttctaaataattaatatgttttaaggagaaataaaatatcacagtctaaaaataataaaaacattttctgagt

SEQ ID NO: 58236 - DNA, 4727 bp, Homo sapiens
  misc_feature (2849)..(2849): n is a, c, g, or t
gtgtgattggctgttgccatggatacgctttgtgtagcggctatgggcgctgtcttacaacaaagccaaggaatctcgctgctgagggcagttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatncagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaattatggcagctgtggtaatccagtcatactggcgtggttacctcatgcgcagacagactcatttctccacaaggctacatactgctgcaacagaaggcctgccaaattcttccatcaagaatcagactattttaaagaaaggaaaaagagaaaatattgtgaatatccgaaaacagagggagaaggctgctattcttattcaggcagtttggaagggctttattttgcgaaagaaactgacaacagctctagaggctattaagaatgaagaatccgatgaagaatacagagaaatagatttagaggattttatatttgatgaagctgccttagaagaagaatggctagcattagattccacccgcttcccttcacaaacactgcttctttcaaaccagctgcattggccaaagattcctggaaacttaaaatgggatgatacttcatttaatttaccaagtaatccagctcaagcatggttatgtaatgacaaagaaaatttgtcttcttcagaacacacacaatttaatagcagatcagaaaataaaacttcttcctggacacctgaatcaaagaccagtagaaagagtttgctaaaatctgaaa

SEQ ID NO: 58237 - DNA, 4386 bp, Homo sapiens
  misc_feature (2774)..(2774): n is a, c, g, or t
gtgtgattggctgttgccatggatacgctttgtgtagcggctatgggcgctgtcttacaacaaagccaaggaatctcgctgctgagggcagttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatncagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaatgtaagatatataaataatgtttcttttatagatgtatgtttactccttttgatggatgatattagtcaatggtacctagtaatttgctgaaggattcaaatcacaatcatatttcataccgattccattatgttttcgtgaggtgcattatgttttcatgaggtgcacaaatcattaattatagtgcatattaatttgattaaattctcatttaatttctagtagtatttaaatgagtaaatgtgagtttttttctgccttgtaatttctaaataattaatatgttttaaggagaaataaaatatcacagtctaaaaataataaaaacattttctgagt

SEQ ID NO: 58238 - DNA, 3806 bp, Homo sapiens
  misc_feature (2194)..(2194): n is a, c, g, or t
atctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatncagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaatgtaagatatataaataatgtttcttttatagatgtatgtttactccttttgatggatgatattagtcaatggtacctagtaatttgctgaaggattcaaatcacaatcatatttcataccgattccattatgttttcgtgaggtgcattatgttttcatgaggtgcacaaatcattaattatagtgcatattaatttgattaaattctcatttaatttctagtagtatttaaatgagtaaatgtgagtttttttctgccttgtaatttctaaataattaatatgttttaaggagaaataaaatatcacagtctaaaaataataaaaacattttctgagt

SEQ ID NO: 58239 - DNA, 518 bp, Homo sapiens
caccccacatacaatggtgagacagggcctgattaacaacaatagccgttctcattcaagatgagagagacaagaatgacaatatattaactttttaaaatttatattgtttaaaatacttgttatcctctgtattttctgtattttaaaacaataatatttaatatattaaaaattaattatttattagtttacctaatattttcatccaaatagtataacagtttgcagggttatcttagaagttaaagattcagatattaatttggagatcctatctcatctttctttcctctttttgaaagctttaaatagttcattaataagccattgaaataaaactaattacatttgttctttgcttcaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattg

SEQ ID NO: 58240 - DNA, 518 bp, Homo sapiens
ctagcttctcaggcaatggatagggctataaagctcccaaaagtttatgtctttgtgttaagttaccagggcaggtagagaaataccatcaggtagggtcaggattaggcaggtctgagctcagactctccttgtccggggcctgcctcagccactgtggggaacagagggtggttcccaggccaccaggataatgttccagaagaaagtataactgtctctactgtgcagaagagttcacaaagggagtgaggattagctgacagcagtaggtcccacccagctcccacacagttggtgaggctggtctcactcccacagtgtcccgctaacagcaccaggtttagatccaggcagtctgcacacagaactcagacctgacccaagccataagctcccccagagagacagcaataacagctttaaggccattcccttccccatctgcccggaaggcaggcacccagcttctgtgtttgcgtctgcagcatacttcctgctcactcctggattctgtt

SEQ ID NO: 58241 - DNA, 1586 bp, Homo sapiens
agcacttgggagcaagagtctttgtgactggcactcatggacagacagtggtgttcagggacagaacagattttggagggggtggggaggccaataaaccaagaaacgtcagaaataaaagtcgcatgaagtactctgatctctgtatttccttttttttttttttttttgtgaaatttgattttaactcttgcttttttttaatggtttggtgtctgttttttccacccccgctggcgccgagctgcgctgttttgtggttctctttttttttttttttttcttctattttttttttaaattctgaagccagaccgtctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggtgactgtaccagtgtccccagagaaaatcgcagcctcgcagcatggatttaaatgcatgtgcatgcatgtagagacatgaaaaaaggtttctgaccattttacacaggaagtctgtcactttgctggatcgggcttgattgcagcttgtgttttcagctccagttcaacacccatttcctgactagtgagacagcatggccaaagcagctgcatgcagaattttctttttactgtgaaagcaagccccctctgttttaactccttccagttctgaatgctctgtgctttgctaggaccgattgtggggttttgttttcttcttctacaaatccctgtaaacacagctgtattcagtaatggcaaaaaaattctatcctgtaaatagaaatctgatcaatttaatcaaaataaatgtatcccagatgactttgagaccagctggctaccacaggcttcagatgctaaatgctcagtggagatgaatacagtgttatatttacatgtttcagagtgccgggatcagcctataatttgcaaaaagaaattattttctaaagacgagaggtggtcctaccagctcacagctgatggttag

SEQ ID NO: 58242 - DNA, 1887 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatgggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgacc

SEQ ID NO: 58243 - DNA, 487 bp, Homo sapiens
agagggaagagataatttccagaaggaaagggtgggtcaactgtatcacatgccacagagaagccaagtgaagataagcttacaaaagtgtgaatcatggcaatacagtgaaagacagtgatttactgcttttgagggcgtgcatgtatatgattaacggatggaagtgcaggactccaagatttacttccttccctttccagcagaattacctgagacgagtgagtaatgggataatttgtaataccacaggccccttttcaagggaccagtaatcaaaacaggaagatgaaactgagaagatttcaactggaagaatacaacttttgataatttctggatatacctcttaattgcaagcaggagagtcttcagagttttcctgtggttttttttgttgttgttgttgttgttgttgttgttgttgttgttgttgtttgagatggaattttgctccagcctgggtgacagagcaagattctgtctc

SEQ ID NO: 58244 - DNA, 651 bp, Homo sapiens
gaatccgccccctatagggcaagtggcccaagtaacccaaattgcgggcgccatggagggggggggattggtaagttggagtcttgctctgtcacctaggctggagtacagtggcgctatctcggctcactgcaacctctgcctcccaggttcaatgatcctcctgccttagccttcttagtagctgggaccacaggcatgtgccattgtgtctggctgtaatttgcttttttgtaggagctctttataaattctaggtagtagcattttatgtgtcttttagacattctctccaagtttgtggcttgtcagctccctttctttatgagtcatttttaatgaacaaacatgaagtcaaagcacttagtttttttttttttgagacggagtccctctctgtcacctaggctggagtacagtggcgtaatcttggatcactgcaacctctgcctcccgggttcaagtgattcttctacctcagcctcctaagtagctgggattacaggtgtgttccactacgtctagctaattcttgtatttttagtattgacagggtttcactatgtttgtcaggctagtcgtgaactcctgaccttgtgatccgccaggcctcccaaagtgctgggattacagacatgagccaccacaccc

SEQ ID NO: 58245 - DNA, 366 bp, Homo sapiens
gaggcattcagtagaaagtagtggaaaattggttgggggtcatacatctaagcttaggagcattatatgcaatcttacaatattctcaaggccaaatctcatgcatatctttatgcagcccctgtcagagactgcgtttaagaaagaagatactttaaaaaaatggttaaaatggttttttttttttttttttggagacagaatctcgaagtcttggagtctcactctgttgcccaggctggagtacactgtagtcccagctactcaggaggctgagacaggagagtcacttgagctgggcggaggctgcagtgagctgtgatcgtgccactgcacttcagccagggcaacaaagcaagacccctc

SEQ ID NO: 58246 - DNA, 2008 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggttctcgatctacacataggctggaatgcagtggtgttggtgtgataagggtcagtgcagtctcaacctcctgggctcaagtgatcctcctgcctcagccttttgagtagctgggaccacaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgacc

SEQ ID NO: 58247 - DNA, 2242 bp, Homo sapiens
agcacttgggagcaagagtctttgtgactggcactcatggacagacagtggtgttcagggacagaacagattttggagggggtggggaggccaataaaccaagaaacgtcagaaataaaagtcgcatgaagtactctgatctctgtatttccttttttttttttttttttgtgaaatttgattttaactcttgcttttttttaatggtttggtgtctgttttttccacccccgctggcgccgagctgcgctgttttgtggttctctttttttttttttttttcttctattttttttttaaattctgaagccagaccgtctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaaaaaaaaaa

SEQ ID NO: 58248 - DNA, 2061 bp, Homo sapiens
agcacttgggagcaagagtctttgtgactggcactcatggacagacagtggtgttcagggacagaacagattttggagggggtggggaggccaataaaccaagaaacgtcagaaataaaagtcgcatgaagtactctgatctctgtatttccttttttttttttttttttgtgaaatttgattttaactcttgcttttttttaatggtttggtgtctgttttttccacccccgctggcgccgagctgcgctgttttgtggttctctttttttttttttttttcttctattttttttttaaattctgaagccagaccgtctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgaggtcgacctgggagctcaaggctgagttataattatgtcactgcattccagcctagatgacagagcgagaccttgtctaaaa

SEQ ID NO: 58249 - DNA, 2579 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaaaaaaaaaa

SEQ ID NO: 58250 - DNA, 1315 bp, Homo sapiens
gactaggattctctcatgcttaacatgcatcttactggttctttatgaagagctttctcttggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaaaaaaaaaa

SEQ ID NO: 58251 - DNA, 2561 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggttctcgatctacacataggctggaatgcagtggtgttggtgtgataagggtcagtgcagtctcaacctcctgggctcaagtgatcctcctgcctcagccttttgagtagctgggaccacaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaaaaaaaaaa

SEQ ID NO: 58252 - DNA, 1254 bp, Homo sapiens
gcgagagagagaagaggagatgcaacacacttttaaacaagatttcaggagaactcattcactatgttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaaaaaaaaaa

SEQ ID NO: 58253 - DNA, 1589 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggggcaccgaggaagagaaccaatggcagaggccacatgtgcaagcaagatgggagtctggagagcctcaggctaaatcacgagtgctcagccctctcctctttgtaagggcaaccgggtcatatctgccagcatagaactgctctgtccacagccctaaaatctaatacctagaacaataaatgcacttaagcacgtca

SEQ ID NO: 58254 - DNA, 1280 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccagctctgtattctaagaacctggaaacaatctttattcacactgttaagacgattgagaaaaatg

SEQ ID NO: 58255 - DNA, 1385 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggggcaccgaggaagagaaccaatggcagaggccacatgtgcaagcaagatgggagtctggagagcctcaggctaaatcacgagtgctcagccctctcctctttgtaagggcaaccgggtcatatctgccagcatagaactgctctgtccacagccctaaaatctaatacctagaacaataaatgcacttaagcacgtca

SEQ ID NO: 58256 - DNA, 745 bp, Homo sapiens
gtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagactcttttgctatctggaaacccatgtccacctctgacttccactcaaaattgctttcctcacagtctgactgcgagagttgtgaaaaattgggatgtgcttctgaggtgggctgtggaatgccatacagaatctcgaagtcttggagtctcactctgttgcccaggctggagtacagaggttgcagtgaactgagatcgtgccactgaactccagcctgggcgacagggtgagactccgtctcaaaaaataaataaataaaaataaaaataaatacactgagtctcatg

SEQ ID NO: 58257 - DNA, 385 bp, Homo sapiens
gagatgaagtctcgttctgttgcccaagctggtctggaactcctgggctcaagcaatcctcctgcctctgcctcccaaagtgctgagatgataggcatgagccaccatgcccagcctgaagctttgggttcttgagaggatgatgtaaaatattatgatataggcaaagggacacatctgtaagctgacagtgctatgtcagagaaggatcaaagagccagcagtctcagaagagtcctgcttctgtctaatctggggagaagactgttcagtccaatgctacctgaagggccccgggcagtagaccctggtgtagaaggagaaaagtagctccaggagaagccatttaattccactgatagcaggagtcagctattctggattt

SEQ ID NO: 58258 - DNA, 533 bp, Homo sapiens
taatcccagctactggggaggctgaggcacaagaatggagaattgcctccctctgaactttttatttggtgctataaataaaccctttcaggtctgagcggcagtcaggtggatttccagttacttgcagctgaatgcatttctacctgtcactcctcctcaggaccataggttgctctggattcccaccacacacgtggagatactgaggtctggaatgcagagaaaacttccccagtgtcacgtggtggagtcatgagtttactgactcactacccagtgctctttccgctcaagacaacctcgtggtccgttcctttcattcgggctgctgtatgcatggccaacagctgctttgtaaattaaacacttcccatggaggcagtgatgatgatgaccttgcccctgaatctttccagcctcttacgtaaatcgcccctgggtcactgtctccatgcctttggacccaggacagcttccccacatcctttaaaacgatgagataaccacatgtaaacccagtgctcctggaa

SEQ ID NO: 58259 - DNA, 1879 bp, Homo sapiens
catcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58260 - DNA, 2050 bp, Homo sapiens
ggctaccagctgcatggagcagaggtgaacggagggctcccatctgcatcctccttctcctcagcccccggagccacgtacggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58261 - DNA, 1553 bp, Homo sapiens
ggagctggagatctcaagggagttgaacagagaggtgtgattgagagtcagatgatgttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcaaaaaaacaaccagaacaagaacgatcccacactctcaagtaaactacataacatggccttcttggccctca

SEQ ID NO: 58262 - DNA, 907 bp, Homo sapiens
  misc_feature (87)..(87): n is a, c, g, or t
tacgaggcctggtgtgactcggacgaggggctgacggggctgttggagtttgcagagacacggaggaggagagagcctgtgctttgnctgccgcgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagcaactacatggcggaggagtaaaatttgaaggagcgttgttatcgaaagtgtaatcgcccatgccgagatgtggctgtgtacatatttgtgtgtgtgtgtgtgaatataggggtattcatttatatccacacaaacacacaggcatgccgaaaatactgccaactgatccaaaagcggccctcggcactttttactgctttaaaaaagtatcagagaaagcagaattgtcaagttttgaacagcattccatgcctt

SEQ ID NO: 58263 - DNA, 402 bp, Homo sapiens
  misc_feature (87)..(87): n is a, c, g, or t
tacgaggcctggtgtgactcggacgaggggctgacggggctgttggagtttgcagagacacggaggaggagagagcctgtgctttgnctgccgcgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggtggtttatttttcttgctttttggagtcaacacccttcccca

SEQ ID NO: 58264 - DNA, 369 bp, Homo sapiens
acttatttgagggtgggggcaatattatcacccacagtaatagttgcccatttgatgagtgtctccatgtgccaggcactatgctaggtcctttacacaagatgcctcattgtcattgtctgctgaaaacagccacccaatctcagaggactgactttctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58265 - DNA, 353 bp, Homo sapiens
caatcactattgtagccccagactaacgcatagctagccaactgtcaggcatagacagggtctcactatgttgccaggctgttttcgaactcctgggctcaagcaatcctcctatcttggcctcccaaactgctgggattacaagtgtgagtcactgcgcctggcctgaagattctatttcacctatgaaaacatgctttaaactgccacagaatgaagcctgccttgtttaatgtgttgtgtgaaatcaaagaaaaaacagacctcgtttcgtggactaacacacttataacacatcccaggagggcatttaaattttaaagcaacaattaaaaaatagcagtcatcaatca

SEQ ID NO: 58266 - DNA, 2150 bp, Homo sapiens
  misc_feature (87)..(87): n is a, c, g, or t
tacgaggcctggtgtgactcggacgaggggctgacggggctgttggagtttgcagagacacggaggaggagagagcctgtgctttgnctgccgcgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58267 - DNA, 1766 bp, Homo sapiens
catcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58268 - DNA, 1561 bp, Homo sapiens
gataatgaactagcacatgggctgcatcaggaagccctggggacctcgcagaagttgagagtgtggagtgggagaatgggaggagtaatatattaaccttactgatacacaaagttgctccttctttttcttgcagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58269 - DNA, 1676 bp, Homo sapiens
catcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttca

SEQ ID NO: 58270 - DNA, 1224 bp, Homo sapiens
catcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggatacccttctgtcgtcttcttaccgtcctgtagagtt

SEQ ID NO: 58271 - DNA, 1386 bp, Homo sapiens
catcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtgatggactcgcagccagtcagatgtacagtccgcagggcatcagtaatttgcaagacctattgatggcttggatgctctggtggtacaaccagtcctctttccggatgccaatctgactttgaggagcaaggtacctcctgccacattcaccaac

SEQ ID NO: 58272 - DNA, 1193 bp, Homo sapiens
  misc_feature (87)..(87): n is a, c, g, or t
tacgaggcctggtgtgactcggacgaggggctgacggggctgttggagtttgcagagacacggaggaggagagagcctgtgctttgnctgccgcgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagatttattaaaacagatgtgatctaccaataatgttttacatctgatggaaagaattggaatataataatcctacttttctttaatgcattactaattcagacaggcccttctggttgttctgaattggagagagagcagacacttcagttggatttggaatcatccacttttttttgcaggtatttcgaaaaaagcctggttttggtacagctcttccagaacccacgggaagaacctgttcatcagctcatccatccgtctgctgagtaaatgcttattgagcatctactgaatgccagcactgttctttgttcttggaatacatcagtaaacaaaataagaaaaacaaaaccaaacctcctgacctcaaggagcttttattttaggaatgatgtcttttagtcatttaatagttgctgtttttattaactcttaactgtacccataaactggatactttcaactta

SEQ ID NO: 58273 - DNA, 1392 bp, Homo sapiens
  misc_feature (87)..(87): n is a, c, g, or t
tacgaggcctggtgtgactcggacgaggggctgacggggctgttggagtttgcagagacacggaggaggagagagcctgtgctttgnctgccgcgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagatttattaaaacagatgtgatctaccaataatgttttacatctgatggaaagaattggaatataataatcctacttttctttaatgcattactaattcagacaggcccttctggttgttctgaattggagagagagcagacacttcagttggatttggaatcatccacttttttttgcaggtatttcgaaaaaagcctggttttggtacagctcttccagaacccacgggaagaacctgttcatcagctcatccatccgtctgctgagtaaatgcttattgagcatctactgaatgccagcactgttctttgttcttggaatacatcagtaaacaaaataagaaaaacaaaaccaaacctcctgacctcaaggagcttttattttaggaatgatgtcttttagtcatttaatagttgctgtttttattaactcttaactgtacccataaactggatactttcaacttaaaaaaaaaaaagagaaactaattatgtgccctaaggatcaccaggccttaggttctacctttatttttcttctactgttaaatagcaacctcattcctcaggctgctgatggaattggtaactgagtaatcaggccactgtgctcggggacataaaacctgtggctgctgccattgcagagtcccgtcatggatcagag

SEQ ID NO: 58274 - DNA, 450 bp, Homo sapiens
gtgagatggaggcttttcttttcctttcttggggttttttgtttttcttcctcttgcagggggaaacaatgggaaccgaatcaccacagcgctttttttgaaaaatgttatttcttttctcattttgacaagcaactacatggcggaggagtaaaatttgaaggagcgttgttatcgaaagtgtaatcgcccatgccgagatgtggctgtgtacatatttgtgtgtgtgtgtgtgaatataggggtattcatttatatccacacaaacacacaggcatgccgaaaatactgccaactgatccaaaagcggccctcggcactttttactgctttaaaaaagtatcagagaaagcagaattgtcaagttttgaacagcattccatgccttcttgttgaggggactctgtaacattacgaaataaaatgtcccaagaacactttatttgcaaa

SEQ ID NO: 58275 - DNA, 335 bp, Homo sapiens
tttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtacccc

SEQ ID NO: 58276 - DNA, 341 bp, Homo sapiens
atccttagcatgcctgtgttactgagaccataaacttttttgttttccttctgccttcacccagtgtgtgttaagtcttgcttgttaagctcccacacttaaatggctgcttgcagaattgcaaagggactagggagagaacaaaaacagatatgcaggtggtggttgttaaccagacaggatttctaaggagggttcaggcagtcaagtggttttgtgtatgtgttttatgttcatagttttgagttttacaatgtgtgaagcttacttttgctagcattaggtatagtttatttgaaagaatgaggctcctgaaataaacatgccagtaaactatatct

SEQ ID NO: 58277 - DNA, 1212 bp, Homo sapiens
ggcatttcaatacagtgacccaattactttctgtcaacaaattcaccagcaaaataaaggggctaacacattaatgagatttcctgagactgccctgtagagatgcttgcaatcctttgctctggagaagccaggcaccatggcatgaggcagccctgtggagaggttcatgtggtacaggaccaggcctgcagcatcacttgagagaggcaacataactcttttactgactatcacagataggaccacaaaacagccttgtaaactcatcctagaggatctaaaagagaaccccctcataacagaatggcattcccagcttgcaggctctgagactccattgagtcatgccacatgtatggaaaatgatttttggagtgttattctatctaaggaaaaacaaagcaaattttccactttcaagattaaaggacattctgtctacattaagacaagcaggtacaaagaagtaagttactgttggattaagaatatccaagacaatggtcacaacttgaaagcacatggaaaaacatgaattatttttataatgtcagctaatccacagctgtgccacctgttagtatggatgctatccaaaaggatttttgaaaccttgttatccaaatgcagaaatggcagctgaagagatgatttgtgacagcatttgctgagacgaagtctgtccactagatggataaaatcagttcccttttcatagcttgatcatctacatctgctagtgacccagtccatgagagtcaccaagaattgattccactgaggcgatggcaggcggggctttggtgttggaaaagtcagtggttgatatggacagcacagactcacataagctgctggtttattacactagaaaaataagggatcccttgacccagctcggcaagtgtgaaatcacgaaataaatgaaggttaacaaagactggtctaaggaatagttcactacaataccgcaatgctcttctcactaatactcgactctgcatttcggtacttatatctgaaagatttgcaaataatgacaacattcgtgccagacattactgcaagtgaggaacagactaaaggagaggaaggaacaaaatgccttccaagagagaaacattcattagccttactggcaagtgtctaaagcaaacaaggaaactgcaaaataattacttagttacaaataaacgcttttagcacagt

SEQ ID NO: 58278 - DNA, 1127 bp, Homo sapiens
ggaatctctctccccatctaccttagatcctttgctctggagaagccaggcaccatggcatgaggcagccctgtggagaggttcatgtggtacaggaccaggcctgcagcatcacttgagagaggcaacataactcttttactgactatcacagataggaccacaaaacagccttgtaaactcatcctagaggatctaaaagagaaccccctcataacagaatggcattcccagcttgcaggctctgagactccattgagtcatgccacatgtatggaaaatgatttttggagtgttattctatctaaggaaaaacaaagcaaattttccactttcaagattaaaggacattctgtctacattaagacaagcaggtacaaagaagtaagttactgttggattaagaatatccaagacaatggtcacaacttgaaagcacatggaaaaacatgaattatttttataatgtcagctaatccacagctgtgccacctgttagtatggatgctatccaaaaggatttttgaaaccttgttatccaaatgcagaaatggcagctgaagagatgatttgtgacagcatttgctgagacgaagtctgtccactagatggataaaatcagttcccttttcatagcttgatcatctacatctgctagtgacccagtccatgagagtcaccaagaattgattccactgaggcgatggcaggcggggctttggtgttggaaaagtcagtggttgatatggacagcacagactcacataagctgctggtttattacactagaaaaataagggatcccttgacccagctcggcaagtgtgaaatcacgaaataaatgaaggttaacaaagactggtctaaggaatagttcactacaataccgcaatgctcttctcactaatactcgactctgcatttcggtacttatatctgaaagatttgcaaataatgacaacattcgtgccagacattactgcaagtgaggaacagactaaaggagaggaaggaacaaaatgccttccaagagagaaacattcattagccttactggcaagtgtctaaagcaaacaaggaaactgcaaaataattacttagttacaaataaacgcttttagcacagt

SEQ ID NO: 58279 - DNA, 2154 bp, Homo sapiens
agcagaagcagccattatacttctaagctgtgccaactaagtggttcccatttctggagccagagatgataattaagtcattgcaagttgcctgaagagaattactcaggcaactgggaaaggcagtggaaggtctgtgaagcaaagttttcaagtagatattgctattactggcaggtgtgcaaggcgtgtagtaaaatcagtttgtggcataggtcggcccttgctgactaaatcctctctggggattgaattgatgacgactgtgacttgagttggattcgaaaatggcttcccttggcctcttgaaagagtgcagatgaagccttttccgtggatttcagtaactttccagcataccatgacgatttcttccccaaatatacacatgctcttttgctctttgtgcctgatcttcagtaatttttagttttttaacaggcagaaaaaatctagcagctaggaaagttcaagttggggtgggagtttttagtgaacttttctcccaggtgtgtggcctttatttctatttatatatgtttgtaaatggaattaccccctttctcttgcaaaataaccgcttcctggctgttggctcactttgctggaatttttctgaatccaggttaagatttccagaagtcagctttggaaaacgtgacactcctaccaaagtccagatggttagaaagttatcacataccatgggtttcagtgtttttggaaacccgtttttttctggtttttttttccccctctccattttagaatcttctcccagtcccttcgggcctagttctgtctcatcttgctttattgggttttaaaaaccggtcttatttaagcttttctaatttgtatttatgtacttatttattttttggtatgatggcagggaggggacaaagcagaaataccccttttatatgacaatgtgtgagaaaagaaactttagcttaaaactccgtaaaatgtgctcacttcagcagcacatatactaaaattaaaatgatatagagaagattagcatatagaaaaaaagaaaaaagatttccttaaaacaagaaaaccaagaatgtttttggtttgttgcggtgcccagccgaggttgaggagggatgggtattgttggtgcactgctggtttcatttggagtgtgggacattagggtgagacaaggacctggaatttaaaaaccacagaatcaaacactgtgaaccactggtctctggctaagcagatcagttttctgattttccttggaagcgttttgaatttttctgttgaagttggatttcctaatactttttttctcttagataatcagaacaaatggttgaatacattataatacaaaaatttcttcactttttattcttggttttcttgcctcgtttttcggttttaatgccaaatgattgggtcatggggtgggaaataaaaacaactttgtataaatttgtagttgtgtttgaaataatgttgtttatttattattatattgatgtaactctttttcttcagagagctgcagcacttcctagaaacactcattactctgcttgtaagttgcaactccagtgttagtagccaggtaatttcatcatcagctgggtaagaagacttattgaaaaaaacagtagccacctcacttctcagacagatgaggcactttgtgtgtgtgtgtgtgtgtgtgtgtgtgtgtgtgtgtgtctgtgtgtggtttttagctctctttctcccatcagacaatttcttttaccctaagtgagagccagagtgtgtccacttgcaagggcagcctccccaccgctccactattttaacgcttgcccttttttacatatacctcacggggtgtctgtcaccattgaaataccttccctgggtacaaaaatcccattagaaggaataagatctagtagttcagtggcacagtagagcaactatagttaacaaaaatttattgtacatttcaaaatagaggagtggaattggaatgttcctaacacaaagaaatgataaatgagccgggtgccgtggctcacacctataatcccagcactttgggaggctgaggtaggtggatcatttgagctcaggacttcaagaccagctgggcaacatgggaagaccttgactctacaaaatata

SEQ ID NO: 58280 - DNA, 384 bp, Homo sapiens
tgcccaagaacaaagttctggacaaggaatcacgactccaagttcatgttctgggtctgccgctccctggctaatgactttgcccggtcagagcttgtccggggcctgggcttcctggtcagtgaagtgaatgcttgcaaagtcctttccagcttaagaatctggacgctaccagtacatctaacaggtttatttaaaatgaaaaattctgagcatgttatgttttatgttgaaaagtacacataaaatagctgacttttaaaaataaatattttttatttatgtaaatccatgtctatacaactgcaaacttttgatctctaagttcttttttggaacacacgctttgatggatttcaataaacatgaatacattttttaaaa

SEQ ID NO: 58281 - DNA, 3911 bp, Homo sapiens
  misc_feature (170)..(170): n is a, c, g, or t
  misc_feature (1916)..(1916): n is a, c, g, or t
ggggccctgattcacgggccgctggggcagggttgggggttgggggtgcccacagggttggctagtggggttttgggggggcagtgggtgcaaggagtttggtttgtgtctgccggccggcaggcaaacgcaaccacgcggtgggggaggcggctagcgtggtggacggnccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccngcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaacttcttgcttgtccacaaatcattcagatggggtttgggcaggtagcgggaggctggggcaggccagaggcctgcgaagaggagacaggctccagcacccacgctctcacaccccacatctctgcttttcttgctctgctgagactctaatgacaaagccagatttcatcttaacctcaagcttctactttttaaaaaaattttgttttggagacagggtctcactgtcacccaggctggactgcagtggcattatacagctcactgcagccttgaactcctggactaaagggatcctcccacctcagcctcacaagcagcctcacaggcgctcactaccatgcccaactaatttttgtattcttttttttatagagacgaggtttcaccatgttgcctaggctggtctggaactcggctcaagtgatccacctgcctcggcctcccaaagtgctgggattacaggtgtgagccaccatccctggccatgagcttctac

SEQ ID NO: 58282 - DNA, 2309 bp, Homo sapiens
  misc_feature (170)..(170): n is a, c, g, or t
  misc_feature (1704)..(1704): n is a, c, g, or t
  misc_feature (1816)..(1816): n is a, c, g, or t
  misc_feature (2261)..(2262): n is a, c, g, or t
ggggccctgattcacgggccgctggggcagggttgggggttgggggtgcccacagggttggctagtggggttttgggggggcagtgggtgcaaggagtttggtttgtgtctgccggccggcaggcaaacgcaaccacgcggtgggggaggcggctagcgtggtggacggnccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcnccctgtgccccacacagcaggagatgatgatagaggttggctgtcaatggatgcaggggaaaggggtgcctggcaggcattgcagtctgcatgtgtctctgggacaagtgtntttccgtgattgagggtgtctgcaggccagtgtgttcccatgtgaatgcacgtatctgtgtgtgtgcacgactgcttgtgtgagcagatccctagtcgtgtctgggtgtgtatcggttgtgcatgcatttgtgtgcatcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggagcacgtgcctgtagtcccagctacttgggaggctgaggcagaatcgcttgaacctgggaggcggaggttgcagtgagctgagattnngccactgcactgcactccagcctgggcaacagagtgagtactctgcc

SEQ ID NO: 58283 - DNA, 100 bp, Homo sapiens
gctcagaagtggaaaaatatgaagatccattgctgatgggaatcctgccctaagcaaacggtggtgagacatggctgcttttagtgcatttattatgtga

SEQ ID NO: 58284 - DNA, 335 bp, Homo sapiens
  misc_feature (2)..(3): n is a, c, g, or t
  misc_feature (37)..(37): n is a, c, g, or t
  misc_feature (141)..(141): n is a, c, g, or t
tnnctttgcatgtggccattcctctggaaagcatctntatgcctttcatgggggattgagttcctccccacccctgctcctacgccctgtattgctagaagtggttcctctaccataaaatctatcacattagggaaaacntttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagctggttc

SEQ ID NO: 58285 - DNA, 383 bp, Homo sapiens
gtggctcattgtcacatttttctagaaccatagggatgataaagcagcaagccaatggggtaatgagaggtgactagatggaagtgatgggcagtgaaggtgataccttcaaagtgcagaggccaaataatcattcatggacactgagagctgacagctgttgttagagaatgttggagatctgttcttaagcaagtgcagtggaagaattcagaagctttcatacctgcatagagaggtgatatagcctgtttgtcctgttaagaagaaaatgagaagactgtgacaacagccaaccctgaggcttttgccacagttctctggtctcactcctattagcccccaaaagggggaaaaatcccaaacacatgatctccgtaaag

SEQ ID NO: 58286 - DNA, 458 bp, Homo sapiens
acgctagtaacctccattctacttcccctttctgtgagtctccctgttgtagctacctgatgtaagtgaaatcagaccatgtttgatcttttgtgtctggcttattcacttagcatagtattttcaaggtttatccatgcgtgcaaattcccttcttttttatgacgaaatactatttaattgtgtgtgtacatgtgcacacacaatgaaatactatttcatcataaaaaggaagtttgtacacatatatacacacacaccaaattttgtttatccattcatcagttcatgggcatttgcggtttttttccacctttcgactgttgtgactttccgtttatttttaatctgaactttactccatcacttcctccctttccttttttattcgcaccataattttgaacaagcagactttgtattttcattactctggggatttttttgagggaggcttg

SEQ ID NO: 58287 - DNA, 465 bp, Homo sapiens
aggcatgtcttacatggcagcaggtgagggagagcgagagtgtgaaggaggaactgtcaaacatttacaaaaccatcagatcttgtgagaactcactcactatcacaagaacaacatgggggaaaccgcccccatgatccagtcacctcctaccaggtctctcccttgacacatgggaattatggggattacaattctagataatatctgagtgtggacacagagccaaaccatatcaccattctattgatccagtggtggagcacatgaaagacctcaaccccctgcacttgaagccccccatattgtttctgtcttcacccccaaggcaaggttctgcctgtggtagctgcatcccccagacatagtctgtcatagctgttctctgttttgacttttccctggagctgaaaagattggaaatgactgaaaacagtatctgctgattcataaagcagcaccaaa

SEQ ID NO: 58288 - DNA, 273 bp, Homo sapiens
cttgtaagtggaagccgaacaatgtgaacgcttagacacagggaggggaactacacactggggcgcgttgagggggcaaggggagggacagcatcaagaaaaatgctaatgcatactgggtttagcacctaggtgatgagttgataggtacagcaaaccaccgtggcacacatttacctaggtaacaaacctgcacatcctgcatatataccctggagcttaaatttaaaaaggctaacaaaaagaagagttctggaaattctaagtggctaa

SEQ ID NO: 58289 - DNA, 406 bp, Homo sapiens
gcttttaccaaggtaatcaggttaattaaatgagatcataaagatgagcagtaatctgataaaactggtttccttataagaagagggagagagaacaggaatatgcacatggagaaaagtctgtgagaggacacagtgagaaggcagccatcgccaagccaaggagaaaggcctcaccaaaacccaaccctgtctgtaccctgatcttcgacttccagcctccagagccactcagagttctgttatggaagccatcgcggattaacacaagttccagttttggctctagcatttactagatctcttactgagatctcttaagactgtttccttatgtacagtgtgctgatgcctagtttggaggttgtaaggattaagtgagcaaataaagtgctttatacagtca

SEQ ID NO: 58290 - DNA, 529 bp, Homo sapiens
ctcagcctggcccatgttacatcttcttcctgccccctcagcctcctcctctttactgacttctccctgttagcctttaaacatgctcaggtctctgtaaacttagagaggggttttggcatttggctaggctggtctcaaactcctgacctcaagtgatctgactgcctcagcctcccaaagtgctagtgattacaggcatgagccactgcgcccggcctcattcttccttcttgaaacagttttcatttgagcgtcaccattcctcattttccaggttttcttttgatgtatctggttgatccttctcaggctcctacaggtgctcctcctggggatgtaaagttgatgatactcatagtcctaccctaagccctgccctgtcctaactactccccctctatggatgctctaaactgcccccgtggcttatgctgggacctctgtgccagagaccctgaagactctgttgccagctcggatttcttcctgcataccaggtggaattatttcactcctgcttgtcatc

SEQ ID NO: 58291 - DNA, 332 bp, Homo sapiens
aaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccag

SEQ ID NO: 58292 - DNA, 208 bp, Homo sapiens
ttaaaaaatgtttgcactgctcagatggctttggcttcaagttgattagatatggaactggtttataatggattagaatgcaggatttgtttgctttgtaatattttaagaaagcaatgaaagaagcggcaatgacagggagagatattgtatacttacagtctgattcttttttcattaccggaaaagacaactaatttaggaatgt

SEQ ID NO: 58293 - DNA, 284 bp, Homo sapiens
tgacgttcagccatagtcctgtctactagctgagtctgggatttttataggcacaggatttggtgggggagggccatgggtagtttaggaaaaggcaacatttgagtgggaaaacagggatataagttctcactttggggcacagtttcaggcttttcagcttgagagtggggttttgctcagaacctgcccttttctgcctagaatttctctgccccctgcctctatcattgtatcagcaccactgcactccagcctgggtgacaggtgagactctgtctcaa

SEQ ID NO: 58294 - DNA, 1126 bp, Homo sapiens
ctgaaacagcaagtcataatcttgtatctctaaagatagaatacagtgcgatttggaaagacaccacaaaaactcatgatccaaaaaagattaaggctgttattaccaggaggaagagaaagaggacaaaatcaaactggatagatataatagagttgtttgttagaattgtcttcccaggagatggaaaaagacgccatcacaataggattcatgctttagttttcagctacagaaatgtaataactttgccaaagtaattacactacatagagtggcaatcgttctattaaaagtaagacccagtaatgttaggatttgttctggacaatgaaggggatgaggtttaatcttatgacttgaatgccaggtctgaaatcttttcttcaagtgatatttttatgaaactacttaggctgtgtttcacactgggtatgatttctaacctcttataacctgtacagtaatagattatgaaggatgaattatttgaaagctattttgtattatttaggagaggagctcttcaattctgaattgtctgccacttacaagcagaagaaagtttttttctttcattattttagcaactatcaataaaacagtattagaaatgcctactcttcagagatgtaatgggaataaattgtaaagtacttttgatattctaagatgaaagatggtattacacagtcaataattcaatgcttcccacattatgaattttatcaaaattatgtagagagctattagttcattccagcaacaaaacaggcttatataaaaacaaaaacctcctgggtcatgccatcctacaccaaattcctgttaaacagaggcatgatttattccagtgaccttgctatttcttcataactgtaatatgtctaatgttagacattttaaattaacattctattagataaactgagaatttaggtctctcgcaccacccaggcacatactctatctttccccacaaatatccaaatatggtaatataattggattaatacgttcatatgactatataattgttcacagctgagccacttaggtgctataattataatttctttgatacacaaattttgttttattgtgattaaaattgcctgatttctta

SEQ ID NO: 58295 - DNA, 185 bp, Homo sapiens
tgtattaatcacctagaactaacatatgtcaacattgacatgtttgcttcagagctctacatttcctttcctttccctttcccttcctccctttctttgctttcttttctttctttcccttgtttccacagtctcactctgtctcccagattggagtgcagtacatttaattaaattaattaatt

SEQ ID NO: 58296 - DNA, 1016 bp, Homo sapiens
aaagaccgaaggaagggatagagtccacctcagtgtcccaagctcaaatcatgctcagaacatgttcagaccagttctaagtctgtttggccttctggatctgtggtccagaatacttgcagaattttccttatttctagccttttgtgccatatgtgggataattcgctgaatatcatccgtgccatggataactcatacaaaggcacaaacccaagccatgtgaatggcctatttgaaaacttttttttttactgaggcaactgggacagtagctgttgaatgaactcctcttctaccaacgccagaatccagtgacgtttcaccagtatgaagatgggaaccacatgctatacttatagactacagataaacttcatatccttcttatttttattgttaacattactgttttgattctatcattcactcctatttgctgagcatctattatgggcttagtattttgcagctataatgagaagaggaattattttttaaaaaaatgactatagcactctcacattgtagagggacaggattcatatttagatatctaggtgaatttttcatttctgcaaagatggactccagaacctagtgtgaaatgggaatattgagtatgctatgtaatcaaggaatgaaggagaatggagctagatctgtaacaggagctacagaaaacaagatggcaaacaaggtcccagcagaacccagagtcgaaaacaagagaaccaggcgaatgtgagcacccaccagacccacccacagagaatcctagcgactgaagtcattttatgtttgccttcaacttgagataagtcccagaaaattggaggatgtggagaccaggatgcctcattgcacaactccaggaggcacattacagtaggtgtgcaagagggcatgacactcaagttacaaacacatcatttcatttaatcttcacaacactcctggaaaaaaggcattattatccttgtcttacagataaagaaactgagactccaagaata

SEQ ID NO: 58297 - DNA, 381 bp, Homo sapiens
cggaacgcgtgggtcgcccacgcgttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgaaaaaaaaaacaaaacaaaacacaaaggg

SEQ ID NO: 58298 - DNA, 5312 bp, Homo sapiens
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttctta

SEQ ID NO: 58299 - DNA, 5477 bp, Homo sapiens
  misc_feature (5467)..(5467): n is a, c, g, or t
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttcttaaactttcttggatcataggatccttttgagaatcagattaaagccaaagatactctttggagaaaaatgcatattcctaattttgcatagatgacctttggattattggactctgactattgggaccctaaatactatttaattataaatctttnttttctcctc

SEQ ID NO: 58300 - DNA, 5221 bp, Homo sapiens
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtga

SEQ ID NO: 58301 - DNA, 4478 bp, Homo sapiens
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtggtaagtactgaggcaagtacaagacggaatgaaaaatgaccctgctggctaggaacagtggttcatgcctataatcccagcactttgggaggctgaagcaggaggatcacttggcccaggagttcaccaccagcccgggcaaaaaagcgagaccctgtctcta

SEQ ID NO: 58302 - DNA, 909 bp, Homo sapiens
ggggtggaagacaaaacagctttttattctttgatttttttataatatttacggggaacaggtggggtgtactggggagccgtatcaggtccagggtcctgatgattctccttcaaggggacagtcctgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtga

SEQ ID NO: 58303 - DNA, 203 bp, Homo sapiens
cctggctctcagatgtgcccaagagctgcttctggccaacaactgggtgggagcccaggaagccctgcagctgcatgaaagtctacaggtcagtctgttatttcatctcctagtatacaagagggaagtgtcccaaatccttttctagtcaaatccaagttaataacccagttgcacaagctgtgccaatttggcaggcccag

SEQ ID NO: 58304 - DNA, 326 bp, Homo sapiens
gaaaatgtcttttcggccatgtgcttttgggtttaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggtcagtcagaacctagagcttatctaattctttttctccctttcttaataattgagttgatcaggatcgagcaaggaagacattcgtgtagggcattagtgtcagtagggcaggggtc

SEQ ID NO: 58305 - DNA, 5157 bp, Homo sapiens
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctccacggccgccggggaccctctgaacgc

SEQ ID NO: 58306 - DNA, 5048 bp, Homo sapiens
ggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccagcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtga

SEQ ID NO: 58307 - DNA, 885 bp, Homo sapiens
ttaagaaagttcattgccaacagttgaggataaatagctctattgatttaggcaaatgaatgagaagatttaaacatcatcaagactcccaaagttggtgtaataaaagttgagatgttttgctagatgctgagagaaaaggcataaataggccatttgtgctcctgtaaacaaatgaaattttgtaatgatcaagagacagcatgatattataaaacacactttggactcatcgagacctggctcagagttgtacctaatttgcttatcagcatttggttagaccttagacaaattttataacctctctaagcccattttctttatctgtaaataaaggaaaaagatctgtttggatttgggacaggagagttgtctgttttatagggtaatgtttatgaaaataatttatcacctaggtacttagtaaataccagtttctgtctctgtttttcttcaaagctttgttgacaatgtaggatattgccaactaatcctttgacttgagtgcttagccatgccccaatccaggcagcatgaagaatgatcaagaaggggacacctagtggcagttgacctttgaggatctatctaggatcaggttactgatttgggacctctgaatcagtacatcataacatcgagagtgatctctgccaaaattaaaattctgtcagaacagtataagcagaaggaagacattaggtctttctgaaatatggagctgataacttctatcagttctgaattctgtactgtcccacccccaaatcatctatattgttgcatgtacttagctttgtgccttgaattgctatttcctttttatcttgcactcagatggtatttttagagatgtttcttcaatcaaaacaagataaagtt

SEQ ID NO: 58308 - DNA, 1952 bp, Homo sapiens
ttaagaaagttcattgccaacagttgaggataaatagctctattgatttaggcaaatgaatgagaagatttaaacatcatcaagactcccaaagttggtgtaataaaagttgagatgttttgctagatgctgagagaaaaggcataaataggccatttgtgctcctgtaaacaaatgaaattttgtaatgatcaagagacagcatgatattataaaacacactttggactcatcgagacctggctcagagttgtacctaatttgcttatcagcatttggttagaccttagacaaattttataacctctctaagcccattttctttatctgtaaataaaggaaaaagatctgtttggatttgggacaggagagttgtctgttttatagggtaatgtttatgaaaataatttatcacctaggtacttagtaaataccagtttctgtctctgtttttcttcaaagctttgttgacaatgtaggatattgccaactaatcctttgacttgagtgcttagccatgccccaatccaggcagcatgaagaatgatcaagaaggggacacctagtggcagttgacctttgaggatctatctaggatcaggttactgatttgggacctctgaatcagtacatcataacatcgagagtgatctctgccaaaattaaaattctgtcagaacagtataagcagaaggaagacattaggtctttctgaaatatggagctgataacttctatcagttctgaattctgtactgtcccacccccaaatcatctatattgttgcatgtacttagctttgtgccttgaattgctatttcctttttatcttgcactcagatggtatttttagagatgtttcttcaatcaaaacaagataaagttaaaaaaaaaaaaaaaacagtgacccttttgcataagccagaagagcagtgccttgcttcctgtgaaaaatgcttggcagttagcctgtgtaattatttagcaatcatgttaatagatgtttaagaataatggaactggagctgtactgagccaaggatggaaatgaagacatgtgagactattttttcttcatccaccgatactcttcagttacaaggatttaatttaaaagggttttaattaaatggaatccagaagctttggacgctccagtttttcttcttagagacaaaccctagctcagtttcctggagcttgactcagaatgcagcatggtactccggactgacagtgtgccagctttattcacttatctctctaccttttggcttgcgtttatttcagggctgcctgacattttgaccttatgtacaaagatggccgatacgattatttttcatcatatattacagaaaatactactcttgaaaaatactctgagaaatatgttctatggtcagataagtttgggaaacagtgaattattgttcctcctttgcagaatcacaatgcactgttagctaattaaagactctcagatgtcccactggaaagaatcatgtttagctttgtttaacctagcatttcccaaacttattagagcataaaactttgtttttgtttttttttaataagataggtagctatttccttagaacacagtttgggaaactttttgttcatttgttttaataagataccttaggtagctatttccttagaacacgagccgggtgcatgtgtcacgcctgtaatcccagcactttgggaggcccaggcgggcggatcacctgaggtcaggagatcgagatcatccggcccaacatggtgaaaccccgtctctactaaaaagacaaaaattagccagccatggtggcaggcacctgtagtcctagctactgtggaggctgaggcaggagaatcacttgaacccgggatggggaggttgcagtgagctgagatggcgccactgtactccagcctgggcgacgagcaaaaactccttc

SEQ ID NO: 58309 - DNA, 905 bp, Homo sapiens
cactctagagccacatgtatacagtgtagttttggcaaatttcattcatacctctacctcctttgctgttttccttgaaatagtaaaaattcacatgaatttgcagaaattaagttcttaggagttcttcaacagtattaaagacaggttctgttcccttttggtttcctgcctaactacaggtacagttaaacatggaattaaaagacagcctttattgtaaaattgtcatgtaacagatcctagttgatctctggtttcctggagatttatttagcatttgggagaggatcaacaaaggggcacagcaagcagatactgtagttagtattatttttcccttttttgcttactgtctatcgattagtctttaaattactagtacattttatgataaatttctttgatttattttacctccttttagaatggaagctcctcgaagggcagggaaatctgagtaggcaggcatttaaaaatatttaaaatgttcagttgggtggaagtttagttttatttgccaaattaggcttgtgacatgagaatttgacaaaggggatcaaatatttcgaaccatttaatttatggcatggaaagcttttaaaaatgatcacaaagtgctaatgatttaagtaaattaagatgaagatccacatttaaattatcaacgtgacactttaaaaaattataaaattgtcttaagttgagggaacagttggcctagtgacttacagatttttttatatgttaaaataaccctatgtgtaagtgactgttttccttatttgaaattaagaggaaaagggtgctcataagtcatctttagcagtgaacttaacagaatccagtggatcagttttcctttatgctgatgtgtagtttaatttgtgctgctgaacaagaca

SEQ ID NO: 58310 - DNA, 408 bp, Homo sapiens
aatgcgggtacaaataactgtctcttagggctgttataaagattcctccattgattcagcaattactgagttgccactgtgtgccaagcactgctctaggtgttggagatacagttgtgaacaagacagacaaaaatccctgtctccttagagcttacactacttgcatgtagtgggtgtcggatgacgaataaatgagacatagagatgtcatgtgccagatgctgacatatgctatggaggaaaataaagcaggttagggggaattgggagtgggcatgggtccatgtcaaagagggtgggcagggacagcctagttaagaaggtaatctttgaggagaggtaaggtgtttccagcagagaagctgcaggtgcaaaggccctgaggcaggaagtgtgcctagctct

SEQ ID NO: 58311 - DNA, 216 bp, Homo sapiens
aaaaaagagcccaagcagagtcagcgtgtggcccagaattggcttccaggtcatatattccttgtagcttacccagagcaatgacaggagaaaggcttgggggacaggtgggacctgggcacatcttgcatgccagcctgagagtgggcagtgggtggagagtcccaccagtgtcctgagcagggagaggatggggttccgcatccccagactgga

SEQ ID NO: 58312 - DNA, 110 bp, Homo sapiens
gaggagtctatgatgttggtcagtataaaaggagaaaaagatcctaaaaacattcctaaatattgtttgatttaaaaatatatgttggaaggcaagagagtttgataaaa

SEQ ID NO: 58313 - DNA, 325 bp, Homo sapiens
ttgccgccgcacaccccagcgccttcctaaaaagaaagaagggaggaaaaaaatgccgacgattggtagaatcatagagaagaacaccagccccagggcaggggcttcagcgaaaaatggcagcaactcgtgcgggtcctctggggcggggtttcttggaggcacctagctgccccacggggtacctcgcgccccacgcgagtcagaacctaaagtgctctctgggcaacctgagtgggtagagtgattccgtctttctctggccctgctaggcccaaaggagaggtgtgactatcgtgaggactccacctagggtggagttcct

SEQ ID NO: 58314 - DNA, 1248 bp, Homo sapiens
  misc_feature (153)..(153): n is a, c, g, or t
  misc_feature (166)..(166): n is a, c, g, or t
  misc_feature (233)..(233): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (792)..(792): n is a, c, g, or t
  misc_feature (1248)..(1248): n is a, c, g, or t
gctgggccccatcagcagagccaccaagagtccacacgtggccggtcagcaggaaggtctggacgttcagggtctttcctctaccaggtgagcactcatgaacagtctgagtccgcccatggacggaccgggaccagcactggaggaagacanggatcccaccacnagcaggcacgagacagctccaggcactcaacgtcccaagagggtcaggacaccattcatggacaccnggggtcaagcagtggaggaaggcagggatcccactacgagcaattggtagatagatctggacactcagggtctcatcacagccacacnacntcncagggaaggtctgatgcctcccatgggcactcaggatccagaagtgcaagcagacaaactcgtaacgatgaacaatcaggagacggctccaggcactcagggtcgcgtcaccatgaagcttcctctcgggccgacagctctggacactcgcaggtgggccagggacaatcagaggggcccaggacaagcaggaactggggatccagttttagccaggacagtgacagtcagggacactcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggaganagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaagacggtcaggacaccattcgtggacacccggggtcaagcagaggaggaaggcaggggtaccaccacgagcan

SEQ ID NO: 58315 - DNA, 575 bp, Homo sapiens
aagacacaggctggacaaaggaaggtggacgggacagccagccgtgcagcagcctcacaggacacagctaccagacagagagcaccagctgacactcattcctccagcaccaggaaatgccacagcagaagagagtcttcaagatgggccagacccacttctgcagcatggttgctgggagcctgcacaggccaggcatttctctacaggtgcaattgagaactcactgaggcaaaagggcctttgtcaacccacagaagtgacaagtccaagtgcagaccaggcttcaggtccagttgctcttcaaactcaaaatcccatctctgcaggtctcagccaatcctgctcccgcctgtttttatttcctgcccagagcaagtacagaaccgagggccatcgatgggcgagaaatcactgtgcctccaagctgtatttttcaccgtaacaagtcattacttctgtgcccggagtcatttctcaggatcttaatgcattcgtttatcaatcaatacttaactgatgtctataaagcatgttcaaaatcagaggtgagagcagctcaccaggtaccgact

SEQ ID NO: 58316 - DNA, 386 bp, Homo sapiens
  misc_feature (29)..(29): n is a, c, g, or t
ggaagacgaaggaggagtaaaggcatgtntcacatggcagcaggcaagagagcgtgtgcaggggaactgccccttatgaaaccctcagatctcgtgagacttattcactaccatgaaaacggcacagggaaaacctgcccctaagcttcagttacccccgacaggtccctcacatgacacatggggactatgggagctataattcaagatgagatttgggcagggacacagccaaaccatatcagatacttaccacattagacactgacagacagctcaccacagattctgggctctattcaaggtgttgactttgatctttttccagttgtaaatgtttcatccaaaaaaactgtgattttggcataacttttttcaagagttgc

SEQ ID NO: 58317 - DNA, 458 bp, Homo sapiens
tggcttttttcaatattgtattagtttgcagatacctattactatctggggacccattaatttttttccacaaatatttatcaggctcttacagtgtacaagatgctctagtagtagagtgaacaagagaagcatggattctgtcctttgagtgcttgcctcctggaggacgagaggacaaggaaaccagcagttgcactgctgtgctagaagcacagggtgcggtagaaaatgaggggaaggacatccttgtggacaactacagtggcatctggcactacgcaagtccagacacacaggagacccaaccgctattgtcaaacagtttgccttcgcattatgggcatggaaaacagaacaacagcaaataaatcatgctcttagataactaagtaccaaagaattcagacatacgaaatgcaaacatgaggttaaacccccacctctttatgagtcaa

SEQ ID NO: 58318 - DNA, 367 bp, Homo sapiens
ataagcatatgaatttatctataggccaagttaatgacataactacaaagaaatgacttgtttcaaatgttttaaaccagtgttttggctatactaacttagtgagacatattctaaagaaaaatagagacgcaaagaagatcttacactttaatagtcaattttgtagttgtaatattactatcgatcattttgtaactctcctatatagggtgtaggatggtggaaataagtaattttgttaatgttgttaggaaccaaggctatcagtgtaaaatgaaggagttacaagcataagatgaaagaaggtaagtaaaaagctcattagtatagttcaagtttaacttgtcaggatgagctcatgatt

SEQ ID NO: 58319 - DNA, 230 bp, Homo sapiens
cgcatctcaggccacaggtccccataaaataaagtaccagcccctgcactggctcccgaagacacccaggttccctctcaggctccagacactccccacccacactgggagtttattcccaaattgaaaaaacaaaaacacgtaaatgatgattctctcccagctttctttgaaatcactatttttacatccttgactgctcttcttaaaagcaagtctgtcatttaacc

SEQ ID NO: 58320 - DNA, 318 bp, Homo sapiens
gctgctgggctggggaaaagacaactcgtctcgtccccttgtttatcacatcaaagaagggaaaaagcaagagatggcaagggacaatcaagcctcaatgattatatttatagagcagctaagggtttgcagcctcctctccatcttctggctctaggacacagctgtgttctggggctgagaagtctcagcacaggctcctcctcacagttctagctacaaatgaactgccggatgaactgttctagtttttcctgattgtccaggctggcaaaagtaggggaccaggtggagcctggggcctgcagggctcggcgt

SEQ ID NO: 58321 - DNA, 104 bp, Homo sapiens
cccaaatgtaaaaccatccttagctcacaagccacccaaaaccaggcgacaggcagatcagggtgtgagaccttggagctagagcaggaggcaggaggcgtggg

SEQ ID NO: 58322 - DNA, 715 bp, Homo sapiens
aggcctgggtctgagcccaggagatgtgagtgacttcccgcccttcaccctttgtgtgtgtggcttggactagctccctgttttcaaaggtcctgatgactccagcaggttttccacccagcagtaggcagattgctttttttgagatggagtctcgctctggcgcccaggttggggtgcagtggcgcgatcttggctcactgcagctttcctctcccaggttcaagcgattgtcctgcctcagcctcctgagtagctggtattacaggtgcccaccaccacagccggctaatttttgtgtttttactagagacagggtttcactatattggccaggtcggtctcgaactcctgacctcaggcactctgcccgtcttggcctcccaaagtgccgggattacagatgtgagccaccatgcccggccatcagattgcttttcatgtttgctgctccatggggcaatgccatggccacagccttagcgatacagggcagcagagcatgtgggctgtgtgtgtctgtgtgtgtctacacatattcttgcccacctgcagcatttcaggttaccttgtcccatcccaagccatgctgacctcgaaatgaaaacgaggccaagggagaaattaagaacacaataaaaaaggggaaggctgggcacagtggctcatgcctgtaatctcagcactttgggaggccgaggcgggcggatcacgt

SEQ ID NO: 58323 - DNA, 1228 bp, Homo sapiens
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58324 - DNA, 1134 bp, Homo sapiens
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacacctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58325 - DNA, 929 bp, Homo sapiens
tgcagattcctcatctacaggcgctagtggactggagacggctggcggctgtcccgggacggggaagagagctttggtgcctgagggaagatggcttagggcccggtcccttaaggcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58326 - DNA, 1247 bp, Homo sapiens
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttttggcctcgttggcatcagcggtggagctgctgcggccag

SEQ ID NO: 58327 - DNA, 994 bp, Homo sapiens
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaagtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58328 - DNA, 1135 bp, Homo sapiens
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58329 - DNA, 472 bp, Homo sapiens
  misc_feature (43)..(43): n is a, c, g, or t
caagccgggaagggggaagtctttcgcagggctgcatttgaanaggataccccagcgtatggatgggagtaaggagggccccctggtaaccctatcccagtaaggtccccaacgagcactagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaa

SEQ ID NO: 58330 - DNA, 612 bp, Homo sapiens
agcaagaccctgtctcagaaaaaacaaaaacaaaacactgtaaatgtatcatgtttctcactgctttctatgttaatgctgtgtaaatacttaaaatggaatactgtataaatattatttatattttctcagatgaaaatatatactaaaacatttggtatttctgttttctgtttcattaatgtatatctgatggagtaccatttaggaatataacattattggggcagaggtcccagccattgccaaagttgaatcttttacatttccctgaatcttgaggatgactgaaaaggaagtctttgaaactgcagtttctgaaggatcacagtacaggaatgcctttataaaagctgcagagataaatacatgtacttatatggcatggatatttaaaaccactcactcagaagcatatgaaagaaattcaaccatcattcaacatagaagaagttaattttagtgcaaaagtttttaagtattaaatttcacaataaaggatcaattggcttacttgctgataaattaaaacagaaaacatttaaaatcattctaaattttgtatgatatttttattttggctaggtgcataaaaatgtgttcagattttca

SEQ ID NO: 58331 - DNA, 729 bp, Homo sapiens
ggctggaggctgtgaggcttccagcgggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatggtgcgcataatttattttaaaataacttacctgtaaaaagtagtaagttaaatatctttatttttcaaaatataatttaatgtttaatgtttccccacagactttaaaattactatgctaattttatttttactagagtaagttttgggagatcagcgaaatttcatgcaaacttggagaaaacagaaatgtatttcttttaaaatctgaaatccaaaaaccacaaagctgtaaaaatttaagtttttgtttttactcgtagaataactcggttatgaagaaaattagatgaataaggcatatatagagcagtctgggatgtgtgcaatttgggatgtgtatattcttttgactgatgcaagtggagttgtcttagaccta

SEQ ID NO: 58332 - DNA, 961 bp, Homo sapiens
  misc_feature (6)..(6): n is a, c, g, or t
gccggnacccaacatcatacttccattcagggacttgatacaaaaattttagtttgaactgctattagcaggtggcaggagcgcaccttcaaatgaatcttcaaattggaaaatactgcttcaccacctggagacaaagaagaaaaaagtagaagtcactctgggcaggctacaacacttaacaaaaatttacataaaactgagttatccctatgttccactatatgtaaatactgtataacattaaatgtgtgatatgttttataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgtggatcactttaggtcaggagttcaagaacagcctggccaacatggaaaaccccatctctacaa

SEQ ID NO: 58333 - DNA, 3492 bp, Homo sapiens
  misc_feature (1453)..(1453): n is a, c, g, or t
  misc_feature (1846)..(1846): n is a, c, g, or t
  misc_feature (2123)..(2123): n is a, c, g, or t
ggctggaggctgtgaggcttccagcgggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtcnaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccanttcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtccncttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaaggctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggaatataacattattggggcagaggtcccagccattgccaaagttgaatcttttacatttccctgaatcttgaggatgactgaaaaggaagtctttgaaactgcagtttctgaaggatcacagtacaggaatgcctttataaaagctgcagagataaatacatgtacttatatggcatggatatttaaaaccactcactcagaagcatatgaaagaaattcaaccatcattcaacatagaagaagttaattttagtgcaaaagtttttaagtattaaatttcacaataaaggatcaattggcttacttgctgataaattaaaacagaaaacatttaaaatcattctaaattttgtatgatatttttattttggctaggtgcataaaaatgtgttcagattttca

SEQ ID NO: 58334 - DNA, 1405 bp, Homo sapiens
ggctggaggctgtgaggcttccagcgggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaaggtaatttgcaggggaaagccttccaaatttatgaaaagttcaatcagaagacattcaagtccaaggcacggtggctcacgc

SEQ ID NO: 58335 - DNA, 225 bp, Homo sapiens
ttgctggtggacttagaaactgttgctaattttattgccagacatattgttaagaaattatactgttgctgagggtatatcctgagaaacattagtagaaccgtaaattggggctttttcgtcaagctgtcccgaatatgcttttttggacaaattagtttcttttgttgttattcatgttataaaattctgctttttcaggtaatttgcaggggaaagccttcc

SEQ ID NO: 58336 - DNA, 1258 bp, Homo sapiens
ggctggaggctgtgaggcttccagcgggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttaggtaagaattagattccttataaagaagtagtgataaatcttcattcttgtttttgtttttatttgaaaagggcactaatttaaatagttaagtgattacttaatatttttgcagtggctcaagcaattctcctgcctcagcttcctgagtagctgggactgcacacataacaccactgcagctggctaatttttaaattttttgtagagactgggtctcgttatgttgctcagcctggtcttgaactcctggcctcgagagatcttcctgcctcagcctcctaaagtgctgggattataggcatcagtcactgtgtccagcccttaatagtgtttataaaaattatttttgtacaaattaatgatacttaaaacatcagcaggcattgagaagaaaatacaaagttttgtctgagttttttaaaactcttaatattgtaggattagatggttatttccttaacataacatgacaaaatatgtctcaactcaaaagccaacttgatacttaatagggaaaaagcgtaagcattcctgttaatgtcaggacctggaaaaggatgcaaactatgcacttaagtaagagaaaaaaaatatttatcattggaaaagaaaaggtaggccgttgttaatcctagcactttggaaggctaaggcaggtgtattgcttgagctcaagagtttgagaccagtctgggcaacatggtgaaaccgcatctctacaaataaaaaaaaaaattatttggttacggtggcatgcacctgtagtcccagctactcgagaggcaaaggtgggaagatcgcttgagcctggaag

SEQ ID NO: 58337 - DNA, 3942 bp, Homo sapiens
  misc_feature (1453)..(1453): n is a, c, g, or t
  misc_feature (1846)..(1846): n is a, c, g, or t
  misc_feature (2123)..(2123): n is a, c, g, or t
ggctggaggctgtgaggcttccagcgggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtcnaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccanttcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtccncttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaaggctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgtggatcactttaggtcaggagttcaagaacagcctggccaacatggaaaaccccatctctacaa

SEQ ID NO: 58338 - DNA, 2340 bp, Homo sapiens
  misc_feature (244)..(244): n is a, c, g, or t
  misc_feature (521)..(521): n is a, c, g, or t
agaggggaggattcccaactaagagaaaattaggaagcagttcaattttcttagatagtgaaagatgagaagagttgaaagaagaggctaccaggaacggccagaaagacagttgtgaaattcttggtgtactatgctggtgatctggccaatgttttctttatcatcacagtgggaacaggtctttactggcttattttcttcaaagcacagaagtctgtgtctgttttgctgccaatgccanttcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtccncttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaaggctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgtggatcactttaggtcaggagttcaagaacagcctggccaacatggaaaaccccatctctacaa

SEQ ID NO: 58339 - DNA, 706 bp, Homo sapiens
acacacatgtgcaatgtgcctagcaaaacataaactaagaactgccataacttgtgtgttatcctaatatcatagcaactgtgtgagatgatccagacgatgatggaccaagcagccatgcacagcatagaggattgccacattatcccttgccacgcacaaaagccaattgttctggtattagaatgtcatgtttcgtgacatgtttcaatgtcagtagtatgtggagaaaagttctgatgtttggatgttttcggtgtttaaactccaagatagtcaatctacttgctctactgtttagattcaaataaacgagaaaaagggcaactctagcagatgatcatgcatgctagaatgcagacactggatacttgcacctcctcagaaatcatattcagttgggaaattgccagcctgtgtgcattcacctgcttcaatagcctagaaattggttttactttgccccacactgggaaggatggccaagtgcgtcaaacggagctttaatgtgggctcattgtttgtcagactccatcctgggagctttacggctatcaccacatctaatcctcataacaaccctacatggcgggtaccaatactgagttttacaaaggaattaagcatttatccaagatcacacagctagtgagaagcagagccagaattaaaaaggaaaatttagtctttccacaagataattaaa

SEQ ID NO: 58340 - DNA, 483 bp, Homo sapiens
ctgtccatggaaaaattttcttccatgaaactggtccttggtgtcaaaaaggtttgggactgctagtcaagaccacagttgaaaagatgtattatttgccctttagaagcttacaatctaaactatccaaatccaacataaaggaagtaataatggcttaaaataaacaaaatacactgagcaataatttaaagactcaactaaaatacacattttatgccagtaaaatatcaatgtatttgttatacacaaagaaaaaagcagtgaagaagtttcatcaatccattgtttttacttattttagaatgacaagatattcgtgacagaaaaatacacttgccttttaaagtcaaagcacctatcaagtgccaaattagaagagattgtttcattttataaatcgcagttaggttacagagtaggtgcaaattcagatacacagaaacaaattctttgaaaaagtgccaaaatcatcccccatgt

SEQ ID NO: 58341 - DNA, 220 bp, Homo sapiens
  misc_feature (10)..(10): n is a, c, g, or t
  misc_feature (42)..(42): n is a, c, g, or t
  misc_feature (99)..(99): n is a, c, g, or t
  misc_feature (142)..(142): n is a, c, g, or t
  misc_feature (212)..(212): n is a, c, g, or t
tgagagtctntgcccttcactgttggaccaccattattgtgngtcttgaaaatggtagaagtcggaagtattttgctactgagcgttatggtcggttgngttgtggctgttagctggttcattcaggaggacaggcacaagnattttgaatctgtcattcttgttgaccaaggttttaggctttagtctgtgattacaaatttggctgaatntaagaaaa

SEQ ID NO: 58342 - DNA, 2629 bp, Homo sapiens
tgttgagtgtggaagcgaaaaccaagttaagaagtcctgttatttgggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttaggtggctttgttttgctgttcaggccctctgctgctttcttgtacattgttctcgttttctaaactcctggccacttaattgtaccctgcttaacccatcctcttgttttctggctcaacgctctttcatgtggtggcctgcattttaggtcttaactgcataggctttcaacgccttggttttgcctttccttgatgtttatttgaccttgcccgaggggccagcgcttttgatctgcatcaggctgccttactccactagtgttttgagacccagctacttgccggcgacggtcggtgccttgggtgcggtcaacgttactctctgtgcgcctgatactggtctaaggctaaggttattagctggaacacctagacccgtggcactaacacacagctcttgcagacttgacagccttgcataggttctaaactgcaggagtcaaagcaacgaaggtgcagatgggtgtgtctcaaacctgagtgcgaaaggaaaatgcagaaatcatgagccttttcaactttccagttgatatcttttgtttgcttttttcttttcttatttatttatttatttatttatttatttatttattttgagacggagtttcgcccttgttgcccaggctggagtgcattggcgcgatctcggctcaccgcaacctccgcctcccgggttcaagcgattctcctgcctcagccttccgagtagctgggattacaggcatgagccacctcgcccggccttccggctgatatcttaaaagaacttttcaactttagtaaataccctgtcttaatcaaatctcattaaaagtaccccatatttatcaacaaaacatgaaaatccttggacggcttcaaagttcttacagaaaatattctgcctttcctttccatacaaaggcacagcttcgaaactggtaggtgaagggaaggaaaataaggaattctgttacgaaatcatacaggctgttatttggaaatacagaagggtgtatgtactatatgggatactgcatgctatttggaagaattttgtttatttaaacatttcagcaaattcctcagttttgatatggggtgcagtatttttaactcattgagaaatttctactaacttttttgaatgtgctcttttcccactagttgcactaaggaaagaggttagtcatgtggtaaaattaatagtgacaaagctgtaaatagctctgcaggccaaggtagccatagtaagaagtcctggagatttatggaagaaatttttgttcatggaagcctgtcagacatgaagatgtgggtcttgtgaattggagattcagtgcgtgaggaaaacagcctaactatccataattaaggtaactactgtcagatatttgtaacatagtgaacatcctattatgctagatagaagcattctctatttgaatgttgtttcctgtatcctgtactttctttaagattctagctcaacaagttttaacctgtatttctcttacagctactggaattcagtacgtgaggacttggacttggtgggcacagaatgcatctttttatatcattaaatccaccagaacatctagcatggtcatttgcctaaaacaaagcctctggaaatttagtcaagttgagatgtaaaataaaagattactgaacagaaaaaaacattgagtgcatt

SEQ ID NO: 58343 - DNA, 2486 bp, Homo sapiens
tgttgagtgtggaagcgaaaaccaagttaagaagtcctgttatttgggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttaggtggctttgttttgctgttcaggccctctgctgctttcttgtacattgttctcgttttctaaactcctggccacttaattgtaccctgcttaacccatcctcttgttttctggctcaacgctctttcatgtggtggcctgcattttaggtcttaactgcataggctttcaacgccttggttttgcctttccttgatgtttatttgaccttgcccgaggggccagcgcttttgatctgcatcaggctgccttactccactagtgttttgagacccagctacttgccggcgacggtcggtgccttgggtgcggtcaacgttactctctgtgcgcctgatactggtctaaggctaaggttattagctggaacacctagacccgtggcactaacacacagctcttgcagacttgacagccttgcataggttctaaactgcaggagtcaaagcaacgaaggtgcagatgggtgtgtctcaaacctgagtgcgaaaggaaaatgcagaaatcatgagccttttcaactttccagttgatatcttttgtttgcttttttcttttcttatttatttatttatttatttatttatttatttattttgagacggagtttcgcccttgttgcccaggctggagtgcattggcgcgatctcggctcaccgcaacctccgcctcccgggttcaagcgattctcctgcctcagccttccgagtagctgggattacaggcatgagccacctcgcccggccttccggctgatatcttaaaagaacttttcaactttagtaaataccctgtcttaatcaaatctcattaaaagtaccccatatttatcaacaaaacatgaaaatccttggacggcttcaaagttcttacagaaaatattctgcctttcctttccatacaaaggcacagcttcgaaactggtaggtgaagggaaggaaaataaggaattctgttacgaaatcatacaggctgttatttggaaatacagaagggtgtatgtactatatgggatactgcatgctatttggaagaattttgtttatttaaacatttcagcaaattcctcagttttgatatggggtgcagtatttttaactcattgagaaatttctactaacttttttgaatgtgctcttttcccactagttgcactaaggaaagaggttagtcatgtggtaaaattaatagtgacaaagctgtaaatagctctgcaggccaaggtagccatagtaagaagtcctggagatttatggaagaaatttttgttcatggaagcctgtcagacatgaagatgtgggtcttgtgaattggagattcagtgcgtgaggaaaacagcctaactatccataattaagctactggaattcagtacgtgaggacttggacttggtgggcacagaatgcatctttttatatcattaaatccaccagaacatctagcatggtcatttgcctaaaacaaagcctctggaaatttagtcaagttgagatgtaaaataaaagattactgaacagaaaaaaacattgagtgcatt

SEQ ID NO: 58344 - DNA, 1821 bp, Homo sapiens
tgttgagtgtggaagcgaaaaccaagttaagaagtcctgttatttgggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttaggtggctttgttttgctgttcaggccctctgctgctttcttgtacattgttctcgttttctaaactcctggccacttaattgtaccctgcttaacccatcctcttgttttctggctcaacgctctttcatgtggtggcctgcattttaggtcttaactgcataggctttcaacgccttggttttgcctttccttgatgtttatttgaccttgcccgaggggccagcgcttttgatctgcatcaggctgccttactccactagtgttttgagacccagctacttgccggcgacggtcggtgccttgggtgcggtcaacgttactctctgtgcgcctgatactggtctaaggctaaggttattagctggaacacctagacccgtggcactaacacacagctcttgcagacttgacagccttgcataggttctaaactgcaggagtcaaagcaacgaaggtgcagatgggtgtgtctcaaacctgagtgcgaaaggaaaatgcagaaatcatgagccttttcaactttccagttgatatcttttgtttgcttttttcttttcttatttatttatttatttatttatttatttatttattttgagacggagtttcgcccttgttgcccaggctggagtgcattggcgcgatctcggctcaccgcaacctccgcctcccgggttcaagcgattctcctgcctcagccttccgagtagctgggattacaggcatgagccacctcgcccggccttccggctgatatcttaaaagaacttttcaactttagtaaataccccatatcaaaactgaggaatttgctgaaatgtttaaataaacaaaattcttccaaatagcatgcagtatcccatatagtaca

SEQ ID NO: 58345 - DNA, 458 bp, Homo sapiens
aattcccaaactgctctttttattggctaggaaaagaacaccttacagggaatccgataggttaattcacaatagtgttaggctgtaatgtcattctttaagaatcttttccagtaaacatttgttactttttcaaagtaattgggagctgttgagtgtggaagcgaaaaccaagttaagaagtcctgttatttgggtgagtccagttcctataaaagttctgttggatgtgtcttaaattgttcggtgcacctcagctctctcccgcagggatccggagaaactgcgccattgttgtcttacagagaaacaaccttctaacactctcttcgccgccatctttttcaagattttaaattgaaaatactttttttgacggctcttgccattatgtctggacgttttaatttcaacaaaacgaaataatagtgttaagttctttgagtcaaacccgatat

SEQ ID NO: 58346 - DNA, 338 bp, Homo sapiens
ctgctagagagtatttcagggtctgcagcatgttgttaaggccattaagcatatgttaaggccattaagagcagtaattataaaagggccctgctaaaataaatatcaagttcccttaagaaacttcaaaattatgaaagtttcaggtcattattttgctacaaatgaacttagcagctaagaaaaatgtctgcctgcttataaactaaatatggtataattatatatttctattatgtatttctaaagctacattttcacctaactctactacaaagtagtttctgaaaacaaagtaaaagcagggaaaatcaaacttcaaatataatcaaatatat

SEQ ID NO: 58347 - DNA, 302 bp, Homo sapiens
aatatgacaaggttggcttcatttttagaagtaggtacactgtctccaaagggttttatttactacagatatttggtctgtatatttagtgctgaattgtatgattctaaacattaaaatgtaagcagcacatttaacataaaaaggaaaccagctctaggtgagatacatgtgtcacagagattctcagttattaatgttgctacaaaatttccattctaatagcaccacaagaatccaggtatgcataaggcagtctccattaagaatcagtagcaatcttatgttgcaaaacatagggt

SEQ ID NO: 58348 - DNA, 619 bp, Homo sapiens
tgtttcctagggagcttgacttatattcatgcatttcccatgtcaaacatttatagctaccaattaccaggttcaggttattaggatttgcttttctcccatctttcccctactgttttgtttgtttgtttgccatttggcctctgctttccaataggaaaggaaggaaaaggttaatttgtcatatactctgtgaagagtgtgggtaaatgagtagttgagtcataataaactctgttatctgtgcagattatcagtctttgagcctcatggctgctttcctgccttaccccacctgagcttgagggtagcatacttaggatttgtctatttgcagaattgttttgagagcctaaggccccataactgggaggctgtatgtgcttcatgtcagctccattagtgtctgttttatttagtgctgttttccattatctcgaacagagtcagtcatatagtaagtactcaataaatatgtcttgaatgaaaaaataatttgtattttccaaagccatatggaatgggttttgtcattcattattttggattctcagggtggtattcccctcacacactcctcactcccacccctgggataatcaagagtctaatattgact

SEQ ID NO: 58349 - DNA, 601 bp, Homo sapiens
cagaacagccacccctctctcgggcactgctgccatgaatgccttcctgctctccgcactgtgcctccttggggcctgggccgccttggcaggaggggtcaccgtgcaggatggaaatttctccttttctctggagtcagtgaagaagctcaaagacctccaggagccccaggagcccagggttgggaaactcaggaactttgcacccatccctggtgaacctgtggttcccatcctctgtagcaacccgaactttccagaagaactcaagcctctctgcaaggagcccaatgcccaggagatacttcagaggctggaggaaatcgctgaggacccgggcacatgtgaaatctgtgcctacgctgcctgtaccggatgctaggggggcttgcccactgcctgcctcccctccgcagcagggaagctcttttctcctgcagaaagggccacccatgatactccactcccagcagctcaacctaccctggtccagtcgggaggagcagcccggggaggaactgggtgactggaggcctcgccccaacactgtccttccctgccacttcaacccccagctaataaaccagattccagagtaaaa

SEQ ID NO: 58350 - DNA, 277 bp, Homo sapiens
gttcccatcctctgtagcaacccgaactttccagaagaactcaagcctctctgcaaggagcccaatgcccaggagatacttcagaggctgggtgagcagcctccttcctctctgattggtggggttcgggaatactgtggtggcacttgaggaagagatgtgctctgattggtgggatttggaggaagggctcagctctgactggtggaactagggagcttggctctgattggtgggtctgttccatgcccacttcaattccaagttgtaactgctg

SEQ ID NO: 58351 - DNA, 535 bp, Homo sapiens
atttctctggtaccttggaaactttcttgacatgcatgcaaggaagcctagaacactaccaggggcagtcctcaaccatggaaggatgggggttggtggataaagaccctggatttcctggtacttgttggggcaatctgaagagaattctacacagtttttggaggatccctagcataattgaacactagttgtccctcatggtaaccaactcaataatacacttgtttgccttttctcttttcactatttacattccacattctctcttgtctttcttgtcaccatctttcaaataaactgcatccaaatgcttgtcacagggtctgcagtttactgaaacaaatgactcaaaccccaaattagatcaggagagcctatcacaaaaatgatgcctgccacatcattgccatttagaaccaggatagcaaagaaacacatcctgaaaatttttttcttactagcaaatatcctatgcctggctggcttgcccatcaccagtaagaatggagtgttgacatgaatcaaaaaacat

SEQ ID NO: 58352 - DNA, 318 bp, Homo sapiens
tattacataaagctaaggacaactaatttaaagcaatctaagattgttgaatacaaaaactcctcattttctttattttaaaagtacagaagcatattcattagttatggcaaataaaagggtttctgttggcaaaagtggcttttaaaatatataattcattatagaagaataaaaaaatgcaaagcaataagtcacattcaatagtaatgtttattaactttttaatttacttttaggaatttttaaattacttatatctacattcatatctaactttattatttaaaaaataaactggaatcttactataatgat

SEQ ID NO: 58353 - DNA, 409 bp, Homo sapiens
actggtcctaacttgcctcagaagcatcagaaaaaaaaaagggagacagctagggagtgtggctcactgcatagaggccgtccccacacttggctataccctcttcagttctttggccagatgctgggcagagacaatcaagggcacaggctctcacagagcaggaatgtatgtgagcagtattggtaatactagataacatttactgagcacatactatgtgtcaggcactgtgctgtactttatatttgtttactcatttaattgccaagagcaaaggagcattcagggctaatcaggaaaacaaatggaggcttcccccaaatgccctattttagcactagttcctgggtcactggaagttcttctctgtgtgaccttggagtatcacttaactcctgtgagtccc

SEQ ID NO: 58354 - DNA, 505 bp, Homo sapiens
cctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaataca

SEQ ID NO: 58355 - DNA, 446 bp, Homo sapiens
aatatacgcaaatcaataaatgtcatccagcatataaacagagccaaagacaaaaaccacagaattatctcaatagatgcagaaaaggcctttgacaaaattcaacaacccttcatgctaaaaactctcaataaattagcaatacgttgaagttcttgttgtatcgcatcttggccagcatttgtttttgtcggtgtttcggatcgtcaccattctaagagaacaggaaatgagaatgggtgatatgggtccctgtggagcaataaacatgggagatgcgtttagcccagcccctgctggtaaccaaggtcctcctccaatgacgggtatgaatatgaacaacagagcaactatacctggcccaccaatgggtcctggtcctgccatgggaccagaaggagccgcaaatatgggaactccaatgatgccagataatggagcagtgg

SEQ ID NO: 58356 - DNA, 673 bp, Homo sapiens
gtgacccactccttggctccttacctcaggctcaggagaccttggggctggaaaacaatgggttgtttctgtcctctttctctgattttcttcaccctttcacatggccccaaatggatattaataatcacattttcttactcagagatgtccagatatggaaagagaatgtctttactttggtttaatcagatacaaggacaagtagacttgtggatactgcccacttttgtaagtgatctgaacagcaagctttgaagagctgatagactggcatttcctcaaaaggatctctacatacagtgtgaaaaaaataagagaagaaatggaagcctagaggcaagatgacagaagaaactgtagtgttaatccagataagacattgaagagctaaaccaggattttggtaagaccgatggagagatgtgaatggatctgaatgctaccaagaaggtcaaattcaacggtgcttacaggcataccttggaaacattgcagatttagttctagaacaccacagtaaagcaaatattgcaagaaaatgaatcacatgaattttgggtttcccagcgcacataaaagttatgtttacactatactatagtctaagtgtgtaatagcattatgtattttaaaagtacatgccttaattaaaaaatattttattgctaaa

SEQ ID NO: 58357 - DNA, 449 bp, Homo sapiens
aacacaaagccctcattcttacaatactcttctaatgatagttccatctttatgaacattccaggatctctacatacagtgtgaaaaaaataagagaagaaatggaagcctagaggcaagatgacagaagaaactgtagtgttaatccagataagacattgaagagctaaaccaggattttggtaagaccgatggagagatgtgaatggatctgaatgctaccaagaaggtcaaattcaacggtgcttacaggcataccttggaaacattgcagatttagttctagaacaccacagtaaagcaaatattgcaagaaaatgaatcacatgaattttgggtttcccagcgcacataaaagttatgtttacactatactatagtctaagtgtgtaatagcattatgtattttaaaagtacatgccttaattaaaaaatattttattgctaaa

SEQ ID NO: 58358 - DNA, 432 bp, Homo sapiens
tagtttatcctccctcctccccatttttctccacggattaggcgactgatctctacatacagtgtgaaaaaaataagagaagaaatggaagcctagaggcaagatgacagaagaaactgtagtgttaatccagataagacattgaagagctaaaccaggattttggtaagaccgatggagagatgtgaatggatctgaatgctaccaagaaggtcaaattcaacggtgcttacaggcataccttggaaacattgcagatttagttctagaacaccacagtaaagcaaatattgcaagaaaatgaatcacatgaattttgggtttcccagcgcacataaaagttatgtttacactatactatagtctaagtgtgtaatagcattatgtattttaaaagtacatgccttaattaaaaaatattttattgctaaa

SEQ ID NO: 58359 - DNA, 664 bp, Homo sapiens
gtgacccactccttggctccttacctcaggctcaggagaccttggggctggaaaacaatgggttgtttctgtcctctttctctgattttcttcaccctttcacatggccccaaatggatattaataatcacattttcttactcagagatgtccagatatggaaagagaatgtctttactttggtttaatcagatacaaggacaagtagacttgtggatactgcccacttttgtaagtgatctgaacagcaagctttgaagagctgatagactggcatttcctcaaaaggtacattactttttgtgataaatattacgtttagtaaaagtactacctaatgaatatgtcacaaaatgtgtaagttcatcactgctaattgcatgttcattataaagccttttctatatatctttttggttaaaatatttcccctttgcacagccaaagggaacctttcccactgtattctatgttacgatggagaggagatgagagtgacattcacatagactataattggtattgtgcccatttaaattcagaatactggttgcaagttagatatggtaagacaccataattatattattttattacacccccagtatttttggataaacaattcaacattctctgctgggattggcagtgtagcctaccttaa

SEQ ID NO: 58360 - DNA, 302 bp, Homo sapiens
tagtttatcctccctcctccccatttttctccacggattaggcgactgatctctacatacagtgtgaaaaaaataagagaagaaatggaagcctagaggcaagatgacagaagaaactgtagtgttaatccagataagacattgaagagctaaaccaggattttgggaaaagagaggcctgaggagaaggagagagatggagaacagcatgttggtggaggagtcagcatacaaagtttatagattaagtttgtcatcctatatggacagtttttgggactccaaaataattataaaagtaa

SEQ ID NO: 58361 - DNA, 2485 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58362 - DNA, 798 bp, Homo sapiens
  misc_feature (626)..(626): n is a, c, g, or t
gattcatagaagtagttggctttggagatgaagtcggggaaaatgcagcccacccttgccttcactgctccaacagcctgggctttataaactgtcaagccaacctgcacacaccctgtggacaccatgtctgtgtgtaacctcaggagagaaagcccacactacccggccagatgttcaagctgctgtccagagcctacgctgacgtccaccccatgatgatggacaggtcggagaataggtgtggaggcaatttcctgaagagggggagcatcatcaacggggcggactggtacagcttcacgggagagatggtgaatttgcagcaactaggcaaggagcttttggggctacctgggcctgcaattgtctaagaaataagttttaagaattcagaggctgaaaacagcaatcctacttgggatgtcgtcatgcttacttcagcctgaatcacacagaagaaagccttcaagcatggacctgaagcaatgctgtaaacacaaacatcaaaaggaagaggaggccaggtgtggtggctcacgcatgtaatcccagcactttgggaagcggaggcaggtggatcacctgaggtcaggaattcagatcagctggccaacatggtgaancctgtttctgtaaaaaaaaaaaattaaattttaaattcccaaaaaaaaaaaaaaaaatttgggggcgcggccgaaacttttaaacctttggcgcggcccagaagaaaggtaagccaaaacggcaaggggcccaaaaccgggccgtcaaaccggggggtgtaaaggcacacgg

SEQ ID NO: 58363 - DNA, 2189 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58364 - DNA, 2222 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58365 - DNA, 2508 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagtcgggggttggccatgttttcagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58366 - DNA, 2695 bp, Homo sapiens
cagcggctgcggggacacagtcagctcccgacggggctggagggccctgctaggctgatgagggccttaaagatggggcttttggagctaaacaaacagctgtgatgaggaagcaggaaggtgcccagcaacaatgaggaccctaccctctgcctgggcttacggcatccctgcgagctgcagagcagagatgagccggctgagccgcatctgtcattatccacttctcatccaagtcctgagccccaactgacccattagggtccccaaagacactagacgcccaaagcaggatgtgtcttttgggacgtctttgtgctgcggctgtggctcctgggtggtctgtgcctgtccctgcctaatgcagcatcagctggctgccttcacgggcccttgtgtggcacagctgctttgcagatggagacgccgaggctcagggcagcctgctgcggctggcttgctggtgggtagttgaatctggttggtcttaggctcctcctctggtctctcacaggctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagtcgggggttggccatgttttcagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58367 - DNA, 2347 bp, Homo sapiens
agtgctggtacggccggagtatgggatcggccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagtcgggggttggccatgttttcagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58368 - DNA, 2329 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagagggagccccctcctcagcacagacctgtcctgcttggtggggccctgatgagctcatgcagggtgagcccttcgcctgcctgacccaccaggagcctctgcccaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaaaaaaaaaaac

SEQ ID NO: 58369 - DNA, 2204 bp, Homo sapiens
ggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagactgacccaaacacgcattccacagccagttgacctgtggcgatcctctg

SEQ ID NO: 58370 - DNA, 758 bp, Homo sapiens
gtctgggtaaatggacattgtcaccatggggtctccaggccagcagctgggatgccaggggcctgtgcggctgccccgtgctgtgggcttttctgttagaaaccgattcatccctgacctcaccagagacagcatgggggtggggaagcctgtggactttgccgccaagcggcctgagctcaagatgcagctctgcctcttcccattgcgggacccttaaatgcctcatgccgccatctgcggatctgcaaagtggggatcatatggtccaccttgcagttgttcagcccctcagctgcaggaggggcgtctgtggcgagtacctgctgcactcacctgcctgctgggcacttggctgacaccccgacgtcccggctgtctctgcgcggctgacaccccggcgtcccggctgtctctgtgcggctgacacccctgacgtcccggctgtctctgtgcggctgacacccctgacgtccccgctgtctctgtgccacaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgagttctgacggtctcagggctctggtccagctgtggcctgggtggggtgggtcacattcaggcccccagggcagcccccgtagcctcactgccccatacacacatgctccttttgccac

SEQ ID NO: 58371 - DNA, 517 bp, Homo sapiens
atcacatgggctaaattagggggtggcaaactttttctgtaaaaggtcagatagtaaatatttcaggctttgtgggacacatacaatctataatacacaaagtagtagtattagttcttcttctttctcttcttcatcaaatctctttaaaaatataaaagtcattcctggctcaaaggccatacaaaaataagctgtgggttggacttggacccaggctgcaatttgctaccatcctccacagttatctcatctctccattagaggaacctctgtcatagatactattccctcccattaaaaagattaggaaacaggctctgaaaaatcaagtgaaaatatttgaggtcatatagctcagaggtggcaatgcttggatttcagacctttggacttcgtatccagttctcacttctctctatcctagcacctccattaaagcagtggctctcagctactaggggcagttttcctccacagaggaaatatggaaatgtctggagatgtttttgatatt

SEQ ID NO: 58372 - DNA, 329 bp, Homo sapiens
cacctcgcgaatcaggtcgctcgcgaatcaggtcggtcgcgaatcaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcggtcctcgatacccagccatattgagcagctactccggcacagttgcggacacaaagctggtgtccctggtt

SEQ ID NO: 58373 - DNA, 143 bp, Homo sapiens
aattcaagcttctaacgatgtacggggtcatgaattttatttctgtttgtcgataagaaatgtaagagtggaatgttaataaatttcagtttagttctgtaatgtcaagaatttaagaattaaaaaacggattggttaaaaaa

SEQ ID NO: 58374 - DNA, 1520 bp, Homo sapiens
tggaatatgaccctggttagacggtgtcctcgtcgggttgtcgaccagcgtcgtgacacgtaacgagcccaatcgaacggcccggctcgagagctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58375 - DNA, 2489 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtcttaaaaaaaaaaaaaaaaaaaaaaaacaaaaacaaacaaaaaaaaaaaaaaaaaaaaaaaaaaaaaaaaacaaaccaaagaggggggcgattatgaccacctcggagggcgaaataaaagcacgacagaatatctctagaacacaaggaggacctcaaatagagccgacaccaaaacgacccccaccgccagagcgcgcggcacaaaaaacacacgagagcagaaaagaggaaaaacagacagccacgagaggaccagagacaaaacgccccacaacacacgcgaggagccacacactaggggcaccccccacatagacaacaaaacacacacaagaggcaaacatacgcaccacagaggccatagtgcgcgcacacgcaaaaagatcgcccgcgcacaaacaaacacaacaacaccaagaccacaaaacgaacaactatcaaccacggaaggaatcagtccaaaatcagaggcgagaaccacgccaacacacaacacgaacacaaacaaccaaacaggagaaggaagcacagcgagacccacagcaacaaaaaagaaacaacaacaaagaagccagaaagacaacgacgcgccgaacaagaggaccggccagcgccggagagcagagagaaggcgcggagcgaagcaacgagacgtcagaaaggaccacacgtggagccccacagggcgaccgcacccaaaagtactgcgacgcgcgagaaaccaacacacaggcgcgggagcgcacggcaaggaggcgcgcgagacgggacgtgacacgcaga

SEQ ID NO: 58376 - DNA, 1325 bp, Homo sapiens
tctgtgcgacgtactttctcccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58377 - DNA, 1274 bp, Homo sapiens
atcaacatctcagagtgatgattctccatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58378 - DNA, 1320 bp, Homo sapiens
attcactgaaaattctcaagttagtatgataataatctgaaacaagtttttaaacccttttcacttttcacacatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58379 - DNA, 1103 bp, Homo sapiens
acgtctgatagcggtcggaacggttgatgcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58380 - DNA, 1084 bp, Homo sapiens
ggcagcatatccccgccacctggacctgcgcccgctcggtggagttgggcagcatatcccccgcacctggacctgcgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58381 - DNA, 2451 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaaaaaaaaaaaaaaaaaaaaaaaacaaaaacaaacaaaaaaaaaaaaaaaaaaaaaaaaaaaaaaaaacaaaccaaagaggggggcgattatgaccacctcggagggcgaaataaaagcacgacagaatatctctagaacacaaggaggacctcaaatagagccgacaccaaaacgacccccaccgccagagcgcgcggcacaaaaaacacacgagagcagaaaagaggaaaaacagacagccacgagaggaccagagacaaaacgccccacaacacacgcgaggagccacacactaggggcaccccccacatagacaacaaaacacacacaagaggcaaacatacgcaccacagaggccatagtgcgcgcacacgcaaaaagatcgcccgcgcacaaacaaacacaacaacaccaagaccacaaaacgaacaactatcaaccacggaaggaatcagtccaaaatcagaggcgagaaccacgccaacacacaacacgaacacaaacaaccaaacaggagaaggaagcacagcgagacccacagcaacaaaaaagaaacaacaacaaagaagccagaaagacaacgacgcgccgaacaagaggaccggccagcgccggagagcagagagaaggcgcggagcgaagcaacgagacgtcagaaaggaccacacgtggagccccacagggcgaccgcacccaaaagtactgcgacgcgcgagaaaccaacacacaggcgcgggagcgcacggcaaggaggcgcgcgagacgggacgtgacacgcaga

SEQ ID NO: 58382 - DNA, 1628 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgta

SEQ ID NO: 58383 - DNA, 1247 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58384 - DNA, 889 bp, Homo sapiens
gatcccccgatgagtaaatcttggtgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58385 - DNA, 975 bp, Homo sapiens
  misc_feature (11)..(11): n is a, c, g, or t
  misc_feature (16)..(16): n is a, c, g, or t
  misc_feature (22)..(22): n is a, c, g, or t
  misc_feature (24)..(24): n is a, c, g, or t
ggccagctccncagtnactggngngcggccggcatgggctggtacggaatggtcatgactctcccttgcggagactgggagagcgtctccagcatgaccaggcaaatctgtgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58386 - DNA, 961 bp, Homo sapiens
  misc_feature (11)..(11): n is a, c, g, or t
  misc_feature (16)..(16): n is a, c, g, or t
  misc_feature (22)..(22): n is a, c, g, or t
  misc_feature (24)..(24): n is a, c, g, or t
ggccagctccncagtnactggngngcggccggcatgggctggtacggaatggtcatgactctcccttgcggagactgggagagcgtctccagcatgaccaggcaaatctgcttgacacactcggtgacagactgcggcacgccagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58387 - DNA, 1694 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagccctccctcccccccacccccctggagggttgccctctggggacattcggagtggggtttttatccctgtggtgagccctgagggcagaaaggatggcatgtttcaggggagggggaagccttcctctcaatttgttggcagtgagaattccaataaatgggatttgctctatgccga

SEQ ID NO: 58388 - DNA, 1619 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58389 - DNA, 821 bp, Homo sapiens
tgtcggactgcacaaatcccctccggtcaattaggctgggaggtaggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58390 - DNA, 907 bp, Homo sapiens
gagtatgtatacttggcaagtcaacttatgctgtctatactctgatcttgaactagcgtatttagcgcagagattaatatgtctattcctgaccagtatgcttgacgttgcgatagagaagttctctgctcgcaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58391 - DNA, 1594 bp, Homo sapiens
  misc_feature (13)..(13): n is a, c, g, or t
  misc_feature (17)..(17): n is a, c, g, or t
  misc_feature (29)..(29): n is a, c, g, or t
  misc_feature (33)..(34): n is a, c, g, or t
  misc_feature (36)..(37): n is a, c, g, or t
  misc_feature (41)..(41): n is a, c, g, or t
  misc_feature (48)..(48): n is a, c, g, or t
  misc_feature (51)..(51): n is a, c, g, or t
  misc_feature (56)..(56): n is a, c, g, or t
  misc_feature (58)..(58): n is a, c, g, or t
ccgaggctgcggngggnagtggggaggangggnntnngggnggggggnggnggggngngcctgcgactacgctgcggcctcccgcccgctcccgctcgctcccgcggccctcgctcgcctcgcgccggcagttttgggcctacacctcccctccccccgccagccgccaaagacttgaccacgtaatgagagtactcatcgccgccagtgtgatggatctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58392 - DNA, 1616 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaacttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58393 - DNA, 1468 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
  misc_feature (1447)..(1447): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacatagttcagcgnctgacgggtgccgagctcgat

SEQ ID NO: 58394 - DNA, 1616 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58395 - DNA, 1662 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattacacctccaagattatttgcctgtgctccgtgtccacgcaactcaatcatctgcccaccacctcggtctcacattctctggtgagcagccagtctcgcaacccagtcatatcctatcagctttgccgagtcatatgtctgtttggccatttttggatgcaggatataaattcaggctctcgagtgtgaaggccaaagtgtggtgtgaatccatctctcacccgttgtgtcattccccatcatgaaccagtgtttctgggcctgttt

SEQ ID NO: 58396 - DNA, 1159 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
  misc_feature (1134)..(1134): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggccttatcganggtaccgagctgattgtatagtcat

SEQ ID NO: 58397 - DNA, 1207 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcactagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58398 - DNA, 527 bp, Homo sapiens
atgagtaatctggcaccatgcctggtcatgttaaatttttgtaaagacaaggtctgctatgtttcccaggctggtggtcttgaactcctggcttcaagtgatccttctgcctgccctcccaaagtgctgagattacaggtatgagccaccacacctgactgtgaacttttaatctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58399 - DNA, 918 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccaggtattcggcgctgccgtcctggctgccgtcgtcgacgaacacgatttcccagggttcgcccaggcgtccagcacctccgcaccgcgatgacagggcagacgtcgcgtgtagc

SEQ ID NO: 58400 - DNA, 510 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggtgtggccgcgcggtccaggttcg

SEQ ID NO: 58401 - DNA, 1238 bp, Homo sapiens
ggtagtggggcctgcggtgggagtggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggaaaaaaaaaaaaaaaaaaaaaaaaaaaaaaaaaacaaaccaaagaggggggcgattatgaccacctcggagggcgaaataaaagcacgacagaatatctctagaacacaaggaggacctcaaatagagccgacaccaaaacgacccccaccgccagagcgcgcggcacaaaaaacacacgagagcagaaaagaggaaaaacagacagccacgagaggaccagagacaaaacgccccacaacacacgcgaggagccacacactaggggcaccccccacatagacaacaaaacacacacaagaggcaaacatacgcaccacagaggccatagtgcgcgcacacgcaaaaagatcgcccgcgcacaaacaaacacaacaacaccaagaccacaaaacgaacaactatcaaccacggaaggaatcagtccaaaatcagaggcgagaaccacgccaacacacaacacgaacacaaacaaccaaacaggagaaggaagcacagcgagacccacagcaacaaaaaagaaacaacaacaaagaagccagaaagacaacgacgcgccgaacaagaggaccggccagcgccggagagcagagagaaggcgcggagcgaagcaacgagacgtcagaaaggaccacacgtggagccccacagggcgaccgcacccaaaagtactgcgacgcgcgagaaaccaacacacaggcgcgggagcgcacggcaaggaggcgcgcgagacgggacgtgacacgcaga

SEQ ID NO: 58402 - DNA, 1670 bp, Homo sapiens
  misc_feature (27)..(27): n is a, c, g, or t
  misc_feature (30)..(31): n is a, c, g, or t
  misc_feature (34)..(34): n is a, c, g, or t
  misc_feature (53)..(53): n is a, c, g, or t
ccggagtcgccaccgccgcgccctcgnccnnccncccgcccgccgctcccggncccgcacgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaa

SEQ ID NO: 58403 - DNA, 302 bp, Homo sapiens
ctcaggtgatccacctacctcggcctcccaaagtgctgggattacaggcatgagccaccgcgcccagccagagagaggttttaaatatatatgtttactttaatattaagttataacataattttcatgttattgaaaagctcttccatctaggatcacacaacttcagtgtcagaatcatattgaggtggggaatttgtattagtcaggtttctctaaagggacagaaacaataggatagatgtatatacgaaagggagtttattaggagaattgactcacatgatcataaggtgaagtcc

SEQ ID NO: 58404 - DNA, 318 bp, Homo sapiens
  misc_feature (201)..(201): n is a, c, g, or t
  misc_feature (238)..(238): n is a, c, g, or t
  misc_feature (279)..(279): n is a, c, g, or t
atcttgcatgattaatactattggcctgttccctttatcctcagctggttgtacaattcttgaatgctttcttcttcccctgaggatgctatagatattgttctactgttatctgaaattagtcgttttggagaagtttctccatccagatacctatagagtctgtctttttttttttttttttttttttatatgcaaacnctcgctgtattattcaggctgatctgaatctcctggnctttagtgttgtgacagctttggcctcttaaaactgcaggnttacaggcatgagccacagtgcctggccatcaagtagca

SEQ ID NO: 58405 - DNA, 246 bp, Homo sapiens
ccttgaacgccctgctgagtagagggttgtgttgtaggctccccagcgcttgatgtagctctgagaggtgaggcagggcttgatgtagctctgagaggtgaggcagggcttgatgtagctctgagaggtgaggcagggcctagatccctcccgcttggcatagccctgcccctgtgacctgaacaccccacagcagcaccctggggctgagcagctggggagtcccaccactggcagctacagcct

SEQ ID NO: 58406 - DNA, 1045 bp, Homo sapiens
ttacgttgtgtggtctttcttgtgctgtgttttttatgtactttgtgtttcggtctggttgttttgtgttcggttgttgggtgttcgtctgtttgtgctttgtcctcctctagttctgtttttggttttccttgtttggatctcctgtcgtgtttgctgttcgcgtatttgcgtcgtgtttttttttttatttgctgcgtttgtctttttttttgtgttcttttgtttggcctttgttgtgtctcgggtccttggttccgtgtcgtggttggtgtcggtgtgtgcgtgcgactttggcgtgttgtccttgggtttgtgttggtcctctgttgggtcgtgactactcaggtttgttctgtggttgtagtcgaggtgtgtgtgcgttgcttcctttgttttgtggtctgtctgttttgttttctctctgttctttgtgtgtgcctcttttttcccgtggcgtgtttcggctgaggtttatttcgttctgtccgcttctcttctcgtttgttcccggtgttgttgtgttgctgtgctctttttttggttgttgtgtctgcgtcgtgtcgtatgctcgtttcggttttgctcttttctctttttgctctactgcttacttttgcctttcccttgtctttttctttcttgttcttcaggttgcgttactctggctcgcttctttgttggttgctcgtccgttatggtgctcctctgcttagcgttgttctccttggctcctcctggccctgctctcggtaccctgttagggtcttgctgcgagtagctctgctttggtccgtcgttctgtctgcgtgcactggctgtgtttttttgtcctattcctctgtctgtatactgttgatgtttcggacttgtaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58407 - DNA, 1344 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58408 - DNA, 1380 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgaaaaaaaaaaaagtcgacgccgcgaatttatatatac

SEQ ID NO: 58409 - DNA, 1302 bp, Homo sapiens
  misc_feature (23)..(23): n is a, c, g, or t
aagcagtggtatcaacgcagagngcccattacggccggggagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58410 - DNA, 1073 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctca

SEQ ID NO: 58411 - DNA, 1373 bp, Homo sapiens
  misc_feature (110)..(110): n is a, c, g, or t
tataatcaaagttcagtagccgagatagcgcggtgatcataatttgcaccgagagcacattatcagcgcacaagtctcaaccaggcgtccgtgcgcgttgaacgtaatgncagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58412 - DNA, 1322 bp, Homo sapiens
ctctctctctctctctctctctctctctctgtctctctctctctctgtctctcctcgtgcagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58413 - DNA, 942 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatacggggttgtgattttttagtcgggggaagggtccgggttaaacgggaaataccggtttgggtcaggatggcctaaggggggggaaaaaaggggcagtctaatgggcaataggtattatcggtgaggtatggggttg

SEQ ID NO: 58414 - DNA, 1265 bp, Homo sapiens
aacagtatgattctagcctttgtctgtcgcgatcgtgatatatcgtcgtgacgtgaaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58415 - DNA, 1548 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58416 - DNA, 1297 bp, Homo sapiens
aaaaccatgtgtcgacattaggtgttcggatcctcacctgttcagtagtggcccggagtaaaacgagagttcttgttatgaaatgcagatgacaaatacgcaagacaatactgatatactgataaatgtagcgagatctcgacaacgaaccgacgtctgatattcgggatgtgacagacgcccgaaccagtgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58417 - DNA, 1290 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaataactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58418 - DNA, 1167 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58419 - DNA, 1332 bp, Homo sapiens
catggactgtaaatctaaagacaggggttaggcctctttttaaaaaaaaaaaaataaagaaaaaaaaagagacattttgagccggccttcatcgccgctgaaacgatgttgccaaaaccagttggtgggggcagggcggggcccaatgacgtggagccgaaatcgtggcgatgagaacgtcgtgttcgccgcagagaagaactccgggcgaccgcccgacactgagagtgctcgtgcgtgtatctcctagaccagaataaataaagacgccggggggggtcatccgggggtgttgtagggataccaatcgctagagagggatgtcggaggaggtccctaaagggggtatccttcctcaagagagggggctccaagagagcaggttgtgcggtataaataacccccgccgcagggggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58420 - DNA, 1282 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58421 - DNA, 1431 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaagagggccatccaattcttgggggaaggaagggaattaccactggaattggcgaaggttaattttgggaagaattcccacaagaaaggttacctttcctgggtgaaccaacaacacgtgcactcctcaggcgcgggccgactacaaggcaaccgaacgggaaaagaacaagggggcagaccttacactaacgcctttattcctccgacaaaaaaggtctaatctaacttggacgttaacctaaattcgggccaccttttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatga

SEQ ID NO: 58422 - DNA, 791 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtcttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggt

SEQ ID NO: 58423 - DNA, 856 bp, Homo sapiens
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctaaacttaaaaaatttgggggaacgggggttttttaaaaaaaaatttttttacacaaacaaagtttttttgtgttggggggggggggggggaggcacaacacccaaaaaaaaaaaatctcttgttgtgtggtgggggcgccacaacacaaccccaccgacgaggtagttgtattgacatgtgagaaagacaaacacggtttttttgtggaaggagagagaaagaatgatagatgaaagaaggggatttttttttttttggaaaggaagaacaaaaagaaaaagagctcgtcgttcgaggaaaaaagagagagagaaaagaaaggagacgaaacaaagagaaagagaatagagagaggagaagacgaaggaagaaaaagagagggtgggggggggaggaaa

SEQ ID NO: 58424 - DNA, 854 bp, Homo sapiens
  misc_feature (484)..(484): n is a, c, g, or t
cacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaaaaaaagcttttttactaatgagtaataatnggccacttggccccttttttaactttttctcaaaccttttttcttaaaaacaccccccaaaaaaacacccaccccacacaaaacacccccccaacacacgccgggggggccccacacacacccgccacaacccccccaaccacacacgcgctgtcctcttcgcgggcggcgccggcgcccttctttctttcccacccccccgcacacgtgtcttttctgctctcccccccccccccacgacaacgacaccccccttcccttcttcgccgcgccggggggggaccacacaacaaccacccaccaaccctccccgccacctactgccatctcgtcccctcctcccacaccactctccacaaccatccactcc

SEQ ID NO: 58425 - DNA, 799 bp, Homo sapiens
aataaccgatgcattctttcttgtttaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataa

SEQ ID NO: 58426 - DNA, 2098 bp, Homo sapiens
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggagcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggc

SEQ ID NO: 58427 - DNA, 879 bp, Homo sapiens
cggggttccccaggctcatggaaatacacaggctctcatttagtttgttttccattgaatacatgaagttggcctcatactttgatttttgtttccttttggaatcagttttagtttcctggagcagctgaattagaaacaggctttgaacctagtttatccttagataaatacaatgtctgtgattcaaggaaaaacaatttcttttgaatgataccttttaatcacttttattctccagcataatttttaatctgcgtctttttccttttagaaatctccaaattggacatccagagcagcattcttgttctgtctacgtcttgaattagaaactatcaagctctgtaagtcctgggtgttcacttgcagtggcttttttacctgagaattctgaacactcagtggacatttaacttccccaattgggactgttagaattataatcactcatggggataagtaaaacagaaacagtgtactgttccccaactactgaatatgtgaatattctcactggacatgggacctagtatatatatttttaattattaacataatgtaaatattgcaaacaaataaatgttacagataggtagcatagaatgcaactttctactcaaaagccactctccagagaaaatattggttagatttaggtgcacattctttaattattttttctccatgcacatactaatgttcaggtgttcagtctgtattaaatgccttaaccctatgagtgaaagtattggggtaaagatgacttcataatttctggtaaatattgtgacttatttttgttcttggcgtttgttaatctgaataatgatgtctatgagttgggggccactggcacacctatgcacttggtttatt

SEQ ID NO: 58428 - DNA, 667 bp, Homo sapiens
ccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaagcaatttcctgctgcagagagcattttaagaaaggacagcattcctgtgacctctgcctaccatccataaaatactcattcccctctcagggcaaactttgttaaaaggaagtcttacatggaggacttaaacaaaacagataaaagctgagtggatctgatcagagtggctggggcttggagcttcaccctatggcctttcccagaacccttcgttcccacatgctccacatcctcagctctgcagactccagcttgaaagccttcacccttgaaaaaca

SEQ ID NO: 58429 - DNA, 561 bp, Homo sapiens
ccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaagcaatttcctgctgcagagagcattttaagaaaggacagcattcctgtgacctctgcctaccatccataaaatactcattcccctctcagaatttaagcttcagtggagcagcgatcttatccacctcatccattactctattgccaatgcccagaacagtgcccagaacacata

SEQ ID NO: 58430 - DNA, 274 bp, Homo sapiens
cgcaaggcccgggtcgtccccctcgcgcggtcgggaaaacagctactgagctgcggcccacgaccctcggccgcgcaggggcggggcgggggcgctgcggggtttctctgttgctagagccgtgatgtcacccgcccctcctaacccgcggttggttgttttgtgtttcagctctgcctgcagttgaacacaaagacctggaggagactcccacctccttcagggagaagaaaggaggcagctcgcccctgagttagcagctcgcccctgagtt

SEQ ID NO: 58431 - DNA, 4118 bp, Homo sapiens
  misc_feature (3253)..(3253): n is a, c, g, or t
  misc_feature (3952)..(3952): n is a, c, g, or t
  misc_feature (4054)..(4054): n is a, c, g, or t
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggagcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58432 - DNA, 4143 bp, Homo sapiens
  misc_feature (3278)..(3278): n is a, c, g, or t
  misc_feature (3977)..(3977): n is a, c, g, or t
  misc_feature (4079)..(4079): n is a, c, g, or t
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggaggtcagtgaaggaggctcagttcatgcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58433 - DNA, 4290 bp, Homo sapiens
  misc_feature (3425)..(3425): n is a, c, g, or t
  misc_feature (4124)..(4124): n is a, c, g, or t
  misc_feature (4226)..(4226): n is a, c, g, or t
ccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaagcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58434 - DNA, 4206 bp, Homo sapiens
  misc_feature (3341)..(3341): n is a, c, g, or t
  misc_feature (4040)..(4040): n is a, c, g, or t
  misc_feature (4142)..(4142): n is a, c, g, or t
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggagcaatttcctgctgcagagagcattttaagaaaggacagcattcctgtgacctctgcctaccatccataaaatactcattcccctctcagatataagaagctctgatacgaaagccgggggctcctgttggctggaaggaggtttgcatctgccatcgccagcacttgcggagctgagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58435 - DNA, 4378 bp, Homo sapiens
  misc_feature (3513)..(3513): n is a, c, g, or t
  misc_feature (4212)..(4212): n is a, c, g, or t
  misc_feature (4314)..(4314): n is a, c, g, or t
ccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaagcaatttcctgctgcagagagcattttaagaaaggacagcattcctgtgacctctgcctaccatccataaaatactcattcccctctcagatataagaagctctgatacgaaagccgggggctcctgttggctggaaggaggtttgcatctgccatcgccagcacttgcggagctgagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58436 - DNA, 3985 bp, Homo sapiens
  misc_feature (3120)..(3120): n is a, c, g, or t
  misc_feature (3819)..(3819): n is a, c, g, or t
  misc_feature (3921)..(3921): n is a, c, g, or t
cgcaaggcccgggtcgtccccctcgcgcggtcgggaaaacagctactgagctgcggcccacgaccctcggccgcgcaggggcggggcgggggcgctgcggggtttctctgttgctagagccgtgatgtcacccgcccctcctaacccgcggttggttgttttgtgtttcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58437 - DNA, 3181 bp, Homo sapiens
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggagcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggca

SEQ ID NO: 58438 - DNA, 2480 bp, Homo sapiens
cattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggagcaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccttttaaaaaatacaattttaacacccgggtcctcagaaaaaaaatttttttaaaagggcccacaaaaacaaattccgggcccccgttttaaaaacggggggggggaaaaaaactgggggtacccaaaaaaaattcttttgaaaaaaaccccttttttcccggggggggaaaaaaaaaaaaggccccaacaaaatccctttcaaaaaagttccccccccaaaagggcaaagggccccccc

SEQ ID NO: 58439 - DNA, 2523 bp, Homo sapiens
  misc_feature (1658)..(1658): n is a, c, g, or t
  misc_feature (2357)..(2357): n is a, c, g, or t
  misc_feature (2459)..(2459): n is a, c, g, or t
tctacccttatggcgtaacaggcgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaatggtggtggtttctctttgtcctgtattgcacaaaagtttaactttggactatgaaacagaagcaganttttgataggcttgaagaaacattatttcattaagttattttcaccatattccaattactctaaacaccagtgttcttaattgtggctctagcaatgtgcttttgctaaactgattacatcaaggttcctaaaatgtgctgcagcatctcagttcacacttgtgttatttttgtcttttcttaaacatcaggattttttacatcttccacacaactcttcagttataaatattttgagttctcaccttggaggcacacctttgaaatgtatggcttcgtttttatttgtaccagcccaacatccctaccatggcatgtgttcacacactcgctcctccactccttccttcattcctcttcaaaatgtcactgtttgagtgactcatttcaggtatcatggtaggcacgggactgccatagtcaacaacacagtctctgcctcaaggaacttagattttcccctttattttaagagaaataacattactcttagtggacatgctctatctgttatatttggacaatgagtattccatgattatttattgcatcaagttatttgaaatttaatgcttcttacaaaattccatatactatgcaaatgtaaaatgaagccctatttaaaaggtaattttcagaaacaaattatatgattctcagctattactgtttataaatatcttgcttctgaaaagcaantttgcttccttgactctttcccctggttttgaattctgcctggattttttattcatgttcagtaaaactaaaaccctgcttcccagaagaactgttttggantgcagctatgagtgggggtgatacaatgtgttcaatataatagaataaaaataagttttctaaa

SEQ ID NO: 58440 - DNA, 494 bp, Homo sapiens
tgcagcaagagaaatttggccaggagggggccgttggtgcagaccaagcatccagtgggaacacacaggggtcagctaccttggattcctcctccccacttgggggttcagcttccctatttcccccagggacaaagacccagccaggtcactctcagggattcagggaaaataagcattgtgtctggggcgtaaagaaaggccaagttctgggcatgtggctgcaggcatgtcttacgggacagagacagcccccccagccgaggactggcctcccgataactctgttctgcctggagtgtccttgtgctggacttcctccagcaacctcacccttacagaaaaatagggatgcttttcttgaacttcctctttctattcctccttctaagtcagggacagatggggtggcaggggtgggaagtatactgatctgtttcttgtcactgttgcccctatgtcctgatataaaaacctgggagtcttgtcttttt

SEQ ID NO: 58441 - DNA, 221 bp, Homo sapiens
caaactcatggagggcaggaccttccagagggacagaactctagagaagaagggactcccagggaacagacttctaagggggtaaagcctccaagaaaagtaaaattctatggggcagggaagtcaaatggacagagcctcccagagaataacgctacttcccccgctttcagggtcctgggattccacggggtttatgtgtgagtgtatgtgtgtgtgtg

SEQ ID NO: 58442 - DNA, 466 bp, Homo sapiens
caaaatggaaaaaataaaagaaatgcatataaccatacccagccagttttttcccctccataaaaaggaagcagtgatccccagcccttttcatgccaccccccaacttggcctcggtggctctgttgtttcagctcctcttctctggtagcagcagtttctcctctttggctcaaaaaggagagcaagcgtgttgatctaccctgggtccatccacctgttttgtctctttgtctgcgagggtgactgaatgaagtgctgcctgccacctgactgtgcctctcacccaactgtttgccgcattggagggctggctacaacatgtgaaagtggatcaattgataagtcgagagatgagtcatctgacctgtgcaaaaccagataagcttctgcagtctttgcacagaaatctaaaatctcggccagaatttctgtggcaaagggagagagtcagaaaccggagctg

SEQ ID NO: 58443 - DNA, 413 bp, Homo sapiens
aaaacttatttgttatttatctgaacttccaatttacctgggtattgcatattttatttggcaactctatccttggaaagcaggctaatatgtgcagtgcacctggattcatagatgaagatatgggtgataaaacaagtagaataaaataattgggaacattcagtagtgtatacacagatattcacctcctctataacaaatatgtttagattcatgtttaaaatattcctaataagatgtagaacaacatccctcttggttgtggtattggcttagctcagagaattcagtttctgctgtcatcacagctgggaatgagaaagggaggggctctggttggtctccctctgcctctggagcacacgtggaggacatgaggctgccgcaggagcagctctgaaagctgagtt

SEQ ID NO: 58444 - DNA, 289 bp, Homo sapiens
actttaatttatttcggatgccggaattgtgcccagagtttctcctgagcttgattccatagctagcagcttcaatccttcgcagctgcggtgcgttctgaactctgggctgtcctttcctgacaggcactttccatagcatctgcctgcttaatccctcacggctcagaaatgttaacggcactgttgagtgctgtgattattttgctttcactatgtcaagatttatggccttcgagaagcttcttttgagatagagctagagaaggaaagcagaatttgtaagatc

SEQ ID NO: 58445 - DNA, 386 bp, Homo sapiens
aataaaaaatagtgatcaatctggcagcattttctgaaagttaagcagtattcccaatagctgctaaaagaagacatgttatataatactaagtctgtaagtaggtaaaaattaagagaattgttaatgtgcttgctggggagtgaaattatctctaggcattaccctatacctaacctaggactcagtagactatgatattggcgtagtttgaccaagaattttatcctgatttcagatcgttttctcttcaccagcacttcttcaccaggattatatgaaaaaaattaaacctgatgccctgaggcatccattatatgtgctgaaataacttcttttctcaccatctagaatggtactagctatgtaccactcttgtcagaatc

SEQ ID NO: 58446 - DNA, 781 bp, Homo sapiens
aaaagatgctgttgaaaaaaaattggaggcctttccccttggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggcaagccaaattagagctgagagttgctgtagcaaaagtggaagagttaactaatgtgactgaagatctgcagggacagatgaaaaagaaggagaaggatgtggtgtctgcccatggaagagaggaagcatcagataggcgtttacagcagttacagtctagtataaaacaattagaaataagattatgtgtgacaatccaagaagccaaccaattaagaaccgaaaatacacatctggaaaaacagaccagagagctacaagcaaagtgcaatgaattagaaaatgagagatatgaggctattgtaagagccagaaatagcatgcaactcttagaagaagctaaccttcaaaaaagtcaggctctacttgaggagaagcaaaaagaagaagacatagag

SEQ ID NO: 58447 - DNA, 462 bp, Homo sapiens
gagctccttgttcttggtcccttcctcccatcattaattctggcacgataagccatttgtactcaagggtcaggaccagttatttcttctctctctggttgggtagtttctttcctcctctagaagcagggagccatacatcactggtcctagggacagaggaaaaacatcctatgcagccatgataattcaaaaacacctccttactcccctcccttgcgatacatccctggtcccagggacagagagaaagaacatcctatgctgccatggtaactcaaaaacacttccttatgccccttgcagtccctcccttatacttgtccccataagaacataggagtaagccgggcatagtggcgcatgcctgtagtcccagctactcgggaggctgaggcgggaggatcacttgagccctggagttcaagacctgcttggcaacatagcgagacctcatcttta

SEQ ID NO: 58448 - DNA, 1033 bp, Homo sapiens
atatttagtttaaatgtattgtaagttttatttactagtgaggttgaaataaagatgactttattcacactttcttttggactggtatagattcctggatgttgttgaagaaaaccattctagttccaaaatacagttattgggatctatggataaaccatcagtttaagaactttacttgaaccctttttctaaaataatcaatttaagcatttgcaggcttgggcaagttgcaaattaaaaaatcctatcttgttggtaaaatgaaagttgtcaatttaatgaaattgtttatatttcataataaatacatatggctgtttttgcttcattttggatataattcttgccacctttctagacagatgtcagaactttaaaaaaaaaatactacagataatgtatcattttacaatttatttctataaagcatttatttcttcagagttcatccagttttagcctgttgtagatgatagaaaattttattttgattatggaaataatcacaacatttatttatttttgttccaaaattcaagaaatctagtttttaatggtattttcggatttggagtgaaaaataagctcaagaaatactcttcagtttattgttatttcatatttacattctgaattgaaaccctatttaaagtttcttaattctctactccccacccctccaaaacttattgttgcaaaaatgtaaaaacaatattagagagacgtcttactcttatgaaaataagcccaaaggagtcaagaagtcaagaacattacaaaggagttcaaagaagcatttaggttgatggattaagttcactgtcatgattgtgatgatagttccttgagtgtattcgtacataaaaacataccaaattgtatactgtaaatacatgcagtttattgcgtgttagttattcctcagtaaaggctgtaatcccagcactttgggaggccaaggcgggtggatcacctgaggtcaggagttcgagaccagcctgaccaacatggaggaaccccatctctactt

SEQ ID NO: 58449 - DNA, 456 bp, Homo sapiens
atgccacctgaaggtcctgagagctccctgacatcattcaggactgaaggtagaaagtagaatggccctgggttttctgagggttctttatttgtcttcgagaatattaaagaccagcatctctccagaatacaaataagagtctaatgtgataagaggctgaactgaaggtgtccctagaaaatttaagactaaaatgtcagctgaaagacaaagagaaagatgggattgttcttgcaaaatctcattggtaaagagagagaggattttcctaacaaaaatgttctgaactacaagcatctcagagggatttttgaattttggccagctaaacaccatcaggggttctggggggttagtcaaataaagtcagaaagggcctatctgcggcacaaaacacagcacagccaaagctgtggccaccgcaggaggagcaggagagaacctggtgaggag

SEQ ID NO: 58450 - DNA, 161 bp, Homo sapiens
acccctcagccacctcactctctggccttattccacccattatcaccgttttttcctgcttcctaccagaatgataaactagcaccttcaggagaattcttcttcagaaaaccggagtttcgcccaaggcccaattggttgtgtgtttttttattggataa

SEQ ID NO: 58451 - DNA, 845 bp, Homo sapiens
gcttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaagaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaactggcagcatctacaacctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtg

SEQ ID NO: 58452 - DNA, 906 bp, Homo sapiens
gcttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggtcgtggtgctgatgggcaagaacaccatgatgcggcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaactggcagcatctacaacctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtg

SEQ ID NO: 58453 - DNA, 935 bp, Homo sapiens
cgggaccgcggggatgggtgtcggcgtgaccaggcctgagctccctgtttctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggtcgtggtgctgatgggcaagaacaccatgatgcggcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaactggcagcatctacaacctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtg

SEQ ID NO: 58454 - DNA, 292 bp, Homo sapiens
  misc_feature (191)..(191): n is a, c, g, or t
caattttagaatattttcatcactctgcaaataaaccatatacccattagcagtcatcccttatttcccccattccacacccccacccccagccttaggcaaccattaattgactcaggattaaacaagtttaatcaggattcttcatggatgtactttttagctaactacagtttttcacatggaaatgnaacttacagtaaacacttaacgtaccacagaatttttttctggatttctggtcctgaagcatgaagtgtactagaaaccaattcttctgcggtacttgtgg

SEQ ID NO: 58455 - DNA, 244 bp, Homo sapiens
ctcagctcagctccaggcaaaaagggtttttgaagaaatttctttttccttattgtgtgtagccttggtcgatctgccagtgaagaagccctgcccgcccatggccaagaggtgggcatgtgacttatgctgggacaatcagacacttctcccaggactttgactgcagagtgaagtgggttagaaaagggagaaacttggagtccatccatcttggcagcagagacccagagacagaccagcc

SEQ ID NO: 58456 - DNA, 656 bp, Homo sapiens
tgctattgagttgtatgagttccttatatattttggatattaatgccttactgaaaacatggtttgcaaatattttctcccattctgtaggctgccttttcattttgtagattgttttctttgctgtgcgttatcaccttcctcttagctatctgtattcaaatcttggtactactgactccgtcttatgcctcactgttagtcttcaaagtggaaacctcttgattccttcttcattgcatttgtcaaattcatttttcacttgccatttacattgtcaccattcatggcttaaactactataacagtctttcttctttccctttttctgtaatctgtagtagacacaacagggcaatactaccttcctgtggtttacagtactcatatcattctcatactcaaattttcaataagtccatacagcttccacaataaaggctaaactgtgctagcatttaagctaccatcagacagatttctcaagcccaaatctaatattactctacttaaaatacctccacgggccaggcacaatggctcacgcctgtaatcccagcacttcgggaggctgaggcaagcggatcacttgaggtcaggagttcgaggccagccggaccaacatggtgaaacccaatctctactaaaaatacaaa

SEQ ID NO: 58457 - DNA, 302 bp, Homo sapiens
cctaaaaaaaaaaaaaaaaaaaaagaaaagcttcacagagatatttacatgctatacaactcaccacttaaggcagataattcagtggtttttagtgtagtcacagacatgtgcaaccactaccacatgtgcaattttagaatacttcatcaccttgaaataaaagctcctgtaccctttacgtatccataccctaaacaccccaccccagccccgggcaaccactaatctgctttctgtttctatggatttgcctgttgttgtggacatttcacataaatgaaatcttataatttgtgaca

SEQ ID NO: 58458 - DNA, 676 bp, Homo sapiens
tactatgattattccttccaggagcagcttttaaaagtgcacagcctgtgtagttggagagttctttggaattccaaagccccctgctctttattgaactaaggtttaactggtgttgttatgggctcatctctgtgtcaggtgtccagaattcagcagcaaataaaatgggcatagtcctgacccttaagagcttcaatatagtggaagatttggaacaataaaaaaagacatcgtcgttccatgtaatgggaacaatgacaggagcagtagggggcatgatgagcgcagttaggatactgaccaaaaacatttctagggtcaatgaaagcatcccaggtgcatgaaaataatatttattgacaacatttgccaggcagcatgccaaccactttacaagcattatctcatttaacatttatatagttatatgagataacatatttccattatcctcattttaaagaggaggtagttgcaaattagagaagttaaacaactccttcaggttcacactgtaagaaatgatagagtcccagttcaaacacaggccgagttaaaagtatgagcatttattgttgaaaaaaaacttgaaagataagtgaagtgttaatcagaaggagagagaggttggggaaggaaggaaaggaagagcccccccctcaaaaaaaaagaa

SEQ ID NO: 58459 - DNA, 285 bp, Homo sapiens
cttttccctcaggaacaccaattattcttagatttggccattttacatgatcccatatttcttgtacactttattcatttcttgagattcttttttcttcatctttgactgggttaattctagagcctgatctttgagctccaagattctttctagtctattgaagaaacttttccactgtattttgcatttccctaagtgtgactttcatttccagaagttctgactggttttacttcatgacatcaatctctctggaaaattttcattcatatcctaaattta

SEQ ID NO: 58460 - DNA, 318 bp, Homo sapiens
tttgttagcgtttttatgttatagttgacaaaataaagcttagagaattgccttctaagttcccaggaataagtagtatactttggacaacataggccctaaaataagaaagacttaaatctaattctggctcagccacatgcttgcaatacaacccagtgatattgaaactgagtctcagcagcctcttaactgtgaaaagttgacagcatagtttttcccttgcagggtttttatgaaaccacatctatgaaaatccaagtttgtatgtgaaaagatgtagcacagtgcatgacatgttatgcctatttaattatg

SEQ ID NO: 58461 - DNA, 997 bp, Homo sapiens
cttctctagtttaggtttaacaaagttaaacaatatacatccagatccacgttgatatgctggacataagattgggttgtgtttagctctgagtcacgccctgaagaaacccctgcgaggcatcctgtttgcctctgtgagtggagcgagggagccagctccctgaatcagcccatctccgaggtggctccgaacattgttgctggaagcttagagtccagccttattctctagtccttccaacaattaaaccagctgaatgtggattctctttgcaactgagaacctaactgacagagctggccgcatgttcctggtcattgtagatctttggggatgcccaggtgtgcagaggtaactcctggttggtgacccatgaggacacttcctatgcaaacatcaaggatgtctacttcgtgccatgtcgtgaattctcagggtaggtaatttcgactcgtggccatgagcaaaaggaagcccgatgtgtttctgtttaagcctctcatgatttttttccacaaatgctctcacttggctggttttctgcagccaaacatcagaccttttactgcacccagacacctgggacagccttttcctcacagagggttgaggtatccttatcttatctgctcacccagcatgcactttcaccagcagccctgcttgtgcagtgagcagccaacagaagcctgcttcctgacgcttccggctcctccctacatgggactctgaggtgttcttgagccatgtgacaaaccaacacttcaagatgaaccctctggggccctggactctgacttaaagctgaggaagaggcataagtgacattactcttctgggtggcaacatgtgtgaaaattgccctctagggaaagacaacttggattgaatcaaacgctagagcaagctgcactcatttgccaaatcccctaaacacacatgtgaatttatttgtatctaattattgattaaaccccattgatccccaaattgt

SEQ ID NO: 58462 - DNA, 177 bp, Homo sapiens
aaaccatgaagactttgatatttaaaattcttattttaatactaaatctttgaaatcagtgtatattttatacttacaagacatctgaatttggacttagtcacatttcaagtaagtgctcattagttagtgactaccttagtggacagtgtagatgtagattatgaactttttagg

SEQ ID NO: 58463 - DNA, 549 bp, Homo sapiens
ctgagtctcttgggtgctgtggtagaaattcctacaggggactttgggggtgtagttgcaggcatggtggtcacatgccctcaccaggactccccaagcccagggaacctcttgggcaaaggctccaaggcatgaaacagcctctcattgagggaactgcagaaagccccatgtgtcctcactgaggtcagcagcattctgctctcccagctcctcttcatgcctgcactcgagcagcactgacccgcccagccacttctgtgccggaaagaccgggtaacgaagacgacaacatccctgctctcttggggtgtgtcagcgggtgatggaatagtgaggagctatgaggaagacaaaacagggaccaggcacagagaggaatgcactccgccttcttgagcgcctcctctctgcttgttagtttgcagtctccttgctcggcccatcctcctccaagcctcttctctccccagtctactctccatgagtgatgtctccccagatcatcttctcccattcttctcccactcctaccagatttatgccctc

SEQ ID NO: 58464 - DNA, 614 bp, Homo sapiens
tgagggacctccctagtataagcattacagagcaaattgaccatgcctgcaggaagatttaatacagcagagcagcaagacttttatgcctaaaaattctaaagttattattaaaaagatgtgtatttaatttagctcatgtctttaagacaaagccatctagtggatatttaataaatacttgaaggaaggaaataaaataccaataccaatattacagatgtctgtaaatcccaaataattgaaatcttgcaggtcaaaggaatagtgattgcttctaagaaagaggcaagttcaaagaagttctcttgctaattaagagaactaacttactccaggcaaaccaaggaagacgatggaaaggaggaaaactatacaaatattttcagggtgtggatatgggtgtttcagaaatcaaatggggaaagaaaacaaaaggagaacagaaagagttacgatatcagcaatgggaaatggaagagacaaattcctgaaactgtggggaaactattgctaattaacaaattattttgagaatggaggagtgggttgaatcataaaatgataaagtatatttaaatggaaataaagactttcataacctgaaaaaatca

SEQ ID NO: 58465 - DNA, 619 bp, Homo sapiens
acagctattactgggtagggactccctcaattggcgcaccacagtctatccatcaaaaatttctcaaccatggccctgggattgattgcccaaaacccattagaggactgcagggatctgccagaaggtgggacatgagatatgaatacattccttaaggctctgtagccctgaaaactcagccccagaagatgatctgtgcaggaggttttgagcctatccaggttaccagagacaccaggactacctcctccagccaagactgaccacagtccagagaacaaaacccagatatcagaatctatctctgacactggactcttctttcttgcattgtgggaaatgtaagaactactcttggaaagaaacagtagagaccaagagacactgcgatggaagctgactggtttcagggttcaaaggtctgtgttccaccccaacttggccagttatcagcaggaggggccatgaacaatccagaaaaaccctctgggcctctggttccccatctgaaaaattaaggatagtgaaacttgccttgcctactcacaagtctgtcctgaactcatgaaactctagcagcttttctatctcctcagcttttctatcacttaggtga

SEQ ID NO: 58466 - DNA, 7418 bp, Homo sapiens
  misc_feature (7404)..(7404): n is a, c, g, or t
  misc_feature (7406)..(7406): n is a, c, g, or t
  misc_feature (7408)..(7408): n is a, c, g, or t
  misc_feature (7411)..(7411): n is a, c, g, or t
  misc_feature (7418)..(7418): n is a, c, g, or t
tcgagagcgccgcgaagaggcagcggggcgcgggtggattggggctggaggtgcgcgtcccgtggggtggcaaggcggcactcctggcgctgcgggcgtccccacaggaacagactttgacccagaacacagaacctcacttgtcaacaagaaccttctggaagagaagactggcagaatattttttaagtactaagacttgcctgcgatgtggtctctgcacatagtactaatgaggtgctccttcagattgaccaagtccttggccacaggtccctggtcacttatactcattctcttttctgtacaatatgtatatgggagtggaaagaaatacattggtccttgtggaggaagagattgctctgtttgccactgtgttcctgaaaaggggtctcggggtccaccaggaccaccagggccacagggtccaattggacccctgggagccccaggacccattgggctttcaggagagaaaggaatgagaggggaccgcggccctcctggagcagcaggggacaaaggagataagggtccaactggtgttcctggatttccaggtttagatggcatacctgggcacccagggcctcctggacccagaggcaaacctggtatgagtggccacaatggctcaagaggtgacccagggtttccaggaggaagaggagctcttggcccaggaggccccctaggccatcctggggaaaagggagaaaaaggaaattcagtgttcattttaggtgccgttaaaggtattcagggagacagaggggacccaggactgcctggcttaccaggatcttggggtgcaggaggaccggcaggtcccacaggatatcctggagagccagggttagtgggacctccgggccaaccagggcgtccaggtttgaagggaaatcccggtgtgggagtaaaggggcaaatgggagacccgggtgaggttggtcagcaaggttctcctggacccaccctgttggtagagccacctgacttttgtctctataaaggagaaaagggtataaaaggaattcctggaatggttggactgccaggaccaccaggacgcaagggagaatctggtattggggcaaaaggagaaaaaggtattcctggatttccagggcctcggggggatcctggttcctatggatctccaggttttccaggattaaagggagaactaggactggttggagatcctgggctatttggattaattggcccaaagggggatcctggaaatcgagggcacccaggaccaccaggtgttttggtgactccacctcttccacttaaaggcccaccaggggacccagggttccctggccgctatggagaaacaggggatgttggaccacctggtcccccaggtctcttgggcagaccaggggaagcctgtgcaggcatgataggaccccctgggccacaaggatttcctggtcttcctgggcttccaggagaagctggtattcctgggagacctgattctgctccaggaaaaccagggaagccaggatcacctggcttgcctggagcaccaggcctgcagggcctcccaggatcaagtgtgatatactgtagtgttgggaaccccggaccacaaggaataaaaggcaaagttggtcccccaggaggaagaggcccaaaaggagaaaaaggaaatgaaggactctgtgcctgtgagcctggacccatgggcccccctggccctccaggacttcctgggaggcaggggagtaagggagacttggggctccctggctggcttggaacaaaaggtgacccaggacctcctggtgctgaaggacctccagggctaccaggaaagcatggtgcctctggaccacctggcaacaaaggggcgaagggtgacatggttgtatcaagagttaaagggcacaaaggagaaagaggtcctgatgggcccccaggatttccagggcagccaggatcacatggtcgggatggacatgctggagaaaaaggggatccaggacctccaggggatcatgaagatgcgaccccaggtggtaaaggatttcctggacctctgggccccccaggcaaagcaggacctgttgggcccccaggactgggatttcctggtccaccaggagagcgaggccacccaggagttccaggccacccaggtgtgaggggccctgatggcttaaagggtcagaaaggtgacacaatttcttgcaacgtaacctaccctgggaggcatggccctccaggttttgatggacctccaggtccgaagggatttccaggtccccaaggtgcccctgggctgagtggttcagatgggcataaaggcagacctggcacaccaggaacagcggaaataccaggtccacctggttttcgtggtgacatgggagatccgggttttggaggtgaaaaggggtcctcccctgttgggcccccaggccctcccggctcaccaggagtgaatggtcagaaaggaatcccgggagaccctgcatttggtcacctgggacccccgggaaagaggggtctttcaggagtgccagggataaaaggacccagaggtgatccgggatgtccaggggctgaagggccagctggcattcctggattcctaggtctcaaaggtcccaaaggcagagagggacatgctgggtttccaggtgtcccaggtccacctggccattcctgtgaaagaggtgctccagggataccagggcaaccgggactccctgggtatccaggtagcccaggtgctccaggtgggaaaggacagccgggagatgtggggcctcccgggccagctggaatgaaaggcctccccggactcccaggacggcctggggcacatggtcccccaggcctcccaggaatcccaggtccctttggagatgatgggctacctggtcctccaggtccaaagggaccccgggggctgcctggtttcccaggttttcccggagaaagaggaaagcctggtgcagagggatgtcctggcgcaaagggagaacctggagagaagggcatgtctggccttcctggagaccggggactgagaggggccaaaggagccataggacctcccggagatgaaggagaaatggctatcatttcacaaaagggaacacctggggaacctggacctcctggagatgatggattcccaggagaaagaggtgataaaggaactcccgggatgcaagggagaagaggagagctgggaagatacggaccacctggatttcacagaggggaacctggtgagaaaggtcagccagggcctcctggacccccaggccctccaggctcaactggtctaagagggttcattggttttccaggacttccaggtgaccagggtgagccaggttctccaggtccccctggattttcaggaattgatggagcaagaggacctaaaggaaacaaaggtgaccctgccagtcactttggtccacctggtccaaagggtgagccaggtagccctggatgtccagggcattttggagcatccggagagcagggcttgcctggtattcaagggcccagaggatcacctggaaggccagggccacctggctcctctggaccaccagggtgcccaggtgatcacgggatgcctgggctgaggggacagccaggagaaatgggagaccctgggccaagaggcctccagggggatccagggataccaggtcctccgggaataaaaggtccctccggatcacctggcctgaacggcttgcatggattgaaaggtcagaaaggaactaaaggtgcttcaggtttgcatgatgtggggccacctggtccagtgggaatacctgggctaaaaggggagagaggagaccctgggagcccaggaatctctcctccaggtcctcgtggaaagaaaggtcccccaggacccccagggagttcaggaccacctggtcctgcaggtgccacaggaagagctcctaaggacattcctgacccgggtccacctggagatcagggacctcctggtcctgatggcccaagaggagcacctgggcctccaggcctccctgggagtgttgaccttctgagaggggagccaggtgactgtggtctaccagggccaccaggtccccctggcccaccaggccctccaggatacaaaggctttccaggatgtgatggaaaagatggccagaaaggaccaatgggattcccgggaccgcagggaccacatggatttcctgggccacctggagagaagggtttacctggacctccagggagaaaagggcccactggtcttccaggtcccagaggtgaaccggggccacctgcagatgtggatgactgtccccgaatcccaggccttcctggggcgccaggcatgagaggaccagaaggagccatggggctccctggaatgagaggccccccaggaccagggtgcaaaggagagcctgggctggatggcaggaggggtgtggatggcgtccctgggtctcctgggcctcccggacgtaaaggtgacacaggagaagacggctaccctggaggaccagggcctcctggtcccattggggatcctgggcccaaagggtttggccctggatacctcggtggcttcctcctggttctccacagtcagacggaccaggagcccacctgccccctgggcatgcccaggctctggactgggtatagtctgttatacctggaagggcaagagaaagctcacaatcaagaccttggtctggcagggtcttgccttcccgtatttagcacgctgccctttgcctactgcaacatccaccaggtgtgccactatgcccagagaaacgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatgcacacaggagctggggaccaaggaggagggcaggcccttatgtcacctggcagctgcctggaagatttcagagcagcaccattccttgaatgccagggccggcagggaacttgccactttttcgcaaataagtatagcttctggctcacaacggtgaaagcagacttgcagttttcctctgctccagcaccagacaccttaaaagaaagccaggcccaacgccagaaaatcagccggtgccaggtctgcgtgaagtatagctagagaatgcgaaattcaccaacacgtggccaagagaaacttcctagggggctaagacttcctagactgtgctaagagatgtcatggtgctcattttggactccctttcagtggttccttctgttttgtcgtggttattcccagagtcctctggttccttacacattaagcaaatgctgcacagatggatttgtttggacctcccaatctagggagcctagatactcttattttactgaggatgatcgaagaactggctttacttaaaaatatgctaattctcagaaaggcaagtagatgataaaggccagattacaaattacattactgaaaacttcattcttgggttaacagtatctcaaacaattgaagtcaattactctataatacagtgggcttctggatggattttataggaaaaaataaacaggtcaatgaatgaaactagaaagcagagattttcaacatttcaaaatgatttcctctgtaatctatttttccatatactttaaataatggtaaaaccatgacgcaaagagagatttttttttaaagagaaaaaaaaaaattcacactgccagcgttaacagttcctttcaaaggagaatgaatcatgatggcaggaaggcccacagtcgccgtattccagagatgcgacattagcataaacacatcacagatgaatataaaacattatgttctcttctgcatttttcagagaatagaaatgcctactttggcaacccttttgaaaagtagcaattatggaaaaaaaaatattcaataagagattaggagcctaaaagctattagtgaatattaaggtagttattcacaaaaattgactccccattgcagtgaacttccagacagactgcttttccccagtcggggtccggcgtgtcacaggtgcgtgcgtgctaatgggactgacgctacatggggctcactcaggcaggcacgcgcttcatacaaagcatctcactcccctccccaggagagcctgcacagcttcttgcactcacaacggacactttgctccacacacataatggcagctcacacagggacgtgacagagctatcattatgcacttgggagaaaattaagggccgatttaattaaacttaggtaagaagattcatttaagtcagggttaccccatcaggaggacatggcactatctttaaacgaaacaaagacaatttataatttgaattttatgctcccgtggttggctgttacaggagcatcccattttgccaattttaaagacattcttatatttcatatcagtcttgtaccaaggcaacagtttgacatttggcattagtattttctaaaaaagtttagaatgtgtgtcaatttataatgattatttttttctgtaaagcaaaagatccctttttctgttttgctaggaatttggtgatctaatcctaaatttaaaagatttgttggaaaaaatttttaggaaactcaccttcctcatctaaaagaaaaaggcattttagagaaaactaaagaaatttctcatgagcgtgacactcattttagtgctttgtttccgtgcacttaaaaataattgagaagaaaaactcaattaaaattttgtttataagaaatgttttccttgccaaaccttgatttgtaatgagctcttatatgcagaacacatttcaaatgagttttgctatgggctgcccccagggtggcaatttattttaagagtattttctggtaaaaagaaaaatgtgtattttaagatgaaatattttcttgatgtagcagaatatttcctagttcatttgacccatttgatattttttaaaccatgctctggcatgttgaatatttttgtgcacctaaaacttaagccaatttcaatcttatttgtgattacctttctccttcccaaaaagctttatctattaccaaaagtcaaccctcctaaaagttcaacctgttcatcttgaacttggcctgagaacattttctgggaagaggtaagggtgacaaatggaacatcagaaacgtatcttgcttgctaattattttaaacactttaatgttggtattagaatattatcttcataagttaataaataagtaaaaaaaaaaacccncncnaanacagccn

SEQ ID NO: 58467 - DNA, 1541 bp, Homo sapiens
tcgagagcgccgcgaagaggcagcggggcgcgggtggattggggctggaggtgcgcgtcccgtggggtggcaaggcggcactcctggcgctgcgggcgtccccacaggaacagactttgacccagaacacagaacctcacttgtcaacaagaaccttctggaagagaagactggcagaatattttttaagtactaagacttgcctgcgatgtggtctctgcacatagtactaatgaggtgctccttcagattgaccaagtccttggccacaggtccctggtcacttatactcattctcttttctgtacaatatgtatatgggagtggaaagaaatacattggtccttgtggaggaagagattgctctgtttgccactgtgttcctgaaaaggggtctcggggtccaccaggaccaccagggccacagggtccaattggacccctgggagccccaggacccattgggctttcaggagagaaaggaatgagaggggaccgcggccctcctggagcagcaggggacaaaggagataagggtccaactggtgttcctggatttccaggtttagatggcatacctgggcacccagggcctcctggacccagaggcaaacctggtatgagtggccacaatggctcaagaggtgacccagggtttccaggaggaagaggagctcttggcccaggaggccccctaggccatcctggggaaaagggagaaaaaggaaattcagtgttcattttaggtgccgttaaaggtattcagggagacagaggggacccaggactgcctggcttaccaggatcttggggtgcaggaggaccggcaggtcccacaggatatcctggagagccagggttagtgggacctccgggccaaccagggcgtccaggtttgaagggaaatcccggtgtgggagtaaaggggcaaatgggagacccgggtgaggttggtcagcaaggttctcctggacccaccctgttggtagagccacctgacttttgtctctataaaggagaaaagggtataaaaggaattcctggaatggttggactgccaggaccaccaggacgcaagggagaatctggtattggggcaaaaggagaaaaaggtattcctggatttccagggcctcgggtaagcatcatttgctgttaacatcagtgaatttggagatatttctctttcatgtttttataaaaccaggtcagtagtcccacaagctcaaaagtgaagaatagctcatgtaagaacaaaacattttggacgagaattatggaatatctaaatatcccagagcatccttccattcacatcatttagataaaacaggcaagcaaaagatagaagaatttgggaaaagtgacaggattgtggcatctcttgtctggcacctcagtgccagtaggaaagtagcttggaatagttaatttaagtctatttgaggaaacaacatggtgatataggggcaggagctagaaaaaaagtacaatattaagctccaaacatcaccacatgtcactaatagaaagcccactca

SEQ ID NO: 58468 - DNA, 626 bp, Homo sapiens
gtgttctcaagtttacccagctgctgagtggcagacctagctcaggctgctaaattatgacatgtgcttgttaatgttgttttgacgtgtggattgaaaagaccaccggaagcccagttgtcctttagatgttacagatgagtttgatgtcttgataattgagaaggtaacaaatgcatagaactgggccgtaatagattcttggcaaatattaattcctctgtcagctaccagtgctggtattattggtgccacatgaagattctattgttgcttttcaattgctgggttaaatttctttactttgctcaaaataagccactttttcaatggctgcattcccaaattgtatctgctgcctggttccgtggtccactgtggtatcccatatacctctcacatagagaactggctcaaatagtatctggtttataagtgtgctaattagaacaggtgaagagtaatctcttaagatttttttttttaaggtgaaacagattgtaaaaagagatgatttctgaaggagatggaattcagtatgttaaataataagaatagaccaaattatattcattgtaatttttagggtataaaaggaattcctggaatggttggactgccaggac

SEQ ID NO: 58469 - DNA, 326 bp, Homo sapiens
gtgacacaatttcttgcaacgtaacctaccctgggaggcatggccctccaggttttgatggacctccaggtattatcaatgagaagttactgtcttatatacttcccagagtaaaaaaaaaaaaaccagccagacagataaaccaagagtgaatcctcagactagttaggacatttctgaagttttgagggaccatggataggggaaaacagcatttgtagtaatttgtagttgggcctctagtctgctggtttgagaacactccagatgggcttttcaaatctttgtacaataaaatttaccttgatttgctcacatatcagtta

SEQ ID NO: 58470 - DNA, 522 bp, Homo sapiens
acagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatggtgagtcccgtgcccttgaaaaccctggctcattcaccatttcctaacaccttctcccgccatttctctctggattggacagtaattctgagcactctgcgcttaggacataaggttacggggactgttgcaaaccatagcctgttgggatgcagggccattatcttttaaaaacacttgtgattgattttgatcacattggtagaatttagaagatgagtttgcttcagccatcggtgaaactggagccaatttgtgtgcatacttaccatgctgagtacgactccttttcagcgcttgtattttgttctttatggaataatct

SEQ ID NO: 58471 - DNA, 369 bp, Homo sapiens
tttcagaacacgtatctgcaaaggccagatggaggaaggaagggtctgggaacacctacatggggtgtgtggacacgaggtgtctcttcttcccttcccaaaggtctggcagggtcttgccttcccgtatttagcacgctgccctttgcctactgcaacatccaccaggtgtgccactatgcccagagaaacgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctgg

SEQ ID NO: 58472 - DNA, 350 bp, Homo sapiens
tacacattaagcaaatgctgcacagatggatttgtttggacctcccaatctagggagcctagatactcttattttactgaggatgatcgaagaactggctttacttaaaaatatgctaattctcagaaaggcaagtagatgataaaggccagattacaaattacattactgaaaacttcattcttgggttaacagtatctcaaacaattgaagtcaattactctataatacagtgggcttctggatggattttataggaaaaaataaacaggtcaatgaatgaaactagaaagcagagattttcaacatttcaaaatgatttcctctgtaatctatttttccatatactt

SEQ ID NO: 58473 - DNA, 2988 bp, Homo sapiens
atttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttcacaggacaacgaagtgcatgtggcagtgtgctggcagtggccttgaggctttggaccattggttacaaaacagacacagccaagataagatccacacacacattattaacaaggaagtgatttgctgcaccttgagttgagaggactacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 58474 - DNA, 2683 bp, Homo sapiens
atttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctagatctcagtgctgcaagtcaccgcatacctctaagtgatggaaacagcattcccatcatcggacttggtacctactcagaacctaaatcgctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttcacaggacaacgaagtgcatgtggcagtgtgctggcagtggccttgaggctttggaccattggttacaaaacagacacagccaagataagatccacacacacattattaacaaggaagtgatttgctgcaccttgagttgagaggactacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 58475 - DNA, 2629 bp, Homo sapiens
atttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctagatctcagtgctgcaagtcaccgcatacctctaagtgatggaaacagcattcccatcatcggacttggtacctactcagaacctaaatcgctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttcacaggacaacgaagtgcatgtggcagtgtgctggcagtggccttgaggctttggaccattggttacaaaacagacacagccaagataagatccacacacacattattaacaaggaagtgatttgctgcaccttgagttgagaggactacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaaattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 58476 - DNA, 2852 bp, Homo sapiens
atttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccgtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttcacaggacaacgaagtgcatgtggcagtgtgctggcagtggccttgaggctttggaccattggttacaaaacagacacagccaagataagatccacacacacattattaacaaggaagtgatttgctgcaccttgagttgagaggactacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 58477 - DNA, 964 bp, Homo sapiens
atttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctagatctcagtgctgcaagtcaccgcatacctctaagtgatggaaacagcattcccatcatcggacttggtacctactcagaacctaaatcgctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggtaagttcaaatgtgcttcttattttaaaagacgatatttttaaaactgtgatctgattattcctgtcatatttatggagagagatgcaccctttactttcaatgaaaagtaacagtcagaacaggcattcctaaccataagtacaggtatatgaaatctccacttctgggtactaaataattcttacttttgttttgctggaatgccaaagaaaagagagaggggtggaaggaaaaacagtgtaaacaaaatatgttctaatataaaagtaattaaaatatatgaataagataaattcacaaatcaaaaaatatatatcaagttgttaatatgatgcctacaagaaacaaacttaaaatgatacat

SEQ ID NO: 58478 - DNA, 367 bp, Homo sapiens
gcaatgggatctggagccaaagaaaaatatatctgagttctagctcctcactaagtaactgtgtgataatgggtatgtcactcaccctctttcagctttgggtcctttatgtgtaaaagggaaaaacatatgcctacatcataaggcagatgtgaacatcaaatgttatcagtaactgtcaatctgttttattaattgtagaatgtccaaaatattagtttgtatggacttcaatgagtatgttttgtggagtggagtggggaaagggatcattgcttaccctctgcacatatcatgtttgagcctagtacaagacagccatgagcacaaaggactaagctacttaaatcagccccaaaacaacttc

SEQ ID NO: 58479 - DNA, 194 bp, Homo sapiens
agggcagggcagacagtgcaccaggggaagtgcttccacagggcagagctgggtgcggggacccccagatgcgggcggcaaactggagaccccacaggagccgggactggcttcattcctcattccctgcacctgtgatgggcagcagcggccaccggtgcccactgggcagttccaggccgggccgagggact

SEQ ID NO: 58480 - DNA, 402 bp, Homo sapiens
caagactttgctgtattccaagaatgacaagttcatggagaaatttgactgctttgtcaaagctgggtcacataagcacatgaccctttttgaggacttcgtagggcagagacagaaaggtagttacctgacaacttcaatgggtgagtatgaagccctctccctgtggtctctaaagtcggggtaccatatattctggatttgggggtccagtcttaggttgagaatctgtagcagcccgtatattctcctgactaggcccaggagagcttaaatgttgagatatgtaggtaggttatctgccatatttggggattaaaaccaaccaaaaatatacctctaaaaggacctggacctctttgagggtcttctaggcaaatcctagcaaaatgatggtgggcc

SEQ ID NO: 58481 - DNA, 447 bp, Homo sapiens
aagcttccattcttttcccatcttgatatggagggttctccagaggaaaataaggaaatgagatattacatgcttcaaaggtaagtgttaggctaccacatttgggtaatatatatatctttaaaaaaacagtaaggtactgacagctaagccctgagatttatttgatcattttttttctatctttaaaaaatgaaggctattttttttaagaaaatgaataaaaatgggcatattggctcctgaatgtctaaacctttattttatattgggaatttgaataaaagatccctgagcccatgtgtgatattttagctacgttgaaaacaagcaccccatgcagaccctgctgtgctattatttcctgaagggaacctcagatgtatcagatttactccctggatttggctagtatttccagtgaagtctcttcaactgctgtaaagg

SEQ ID NO: 58482 - DNA, 336 bp, Homo sapiens
taaaatatatttgttgtaaggaagaggagcaaatcaatacttcttgtcctttttataccattggctaaaagccgtgagccaattctcagaatattatatagacccattaagattgcatactgaggtatactgtcagaaggtttgtgagcttttgactgtagccagtgtgtacgtttcttgattacattttatggaaataattcctacttaaatacctttctttgacttatccattaggatgacatcagaattgtgacccttgtacactattgaatctatttcattgttgcctagatagagtaccttcatgtagttaatgtactttaaaaatagaga

SEQ ID NO: 58483 - DNA, 469 bp, Homo sapiens
aatgatgcagccacaaacaaaggaagagtagcagccaccagaaaccagaagaggcaaggaagagattgtcccctaaagcctccaagggaacatggctctgcctacaccttgatttcaacccaacaaaactgtcattgaacttccagcctccagaactaagagaagagtaaattattgtcagctgaaggcaccaagtttgtggaaatttattaaggcagccacaggaaactaatacagcctgtgttaggcaatcctttgcatgtatctcagtaaccaaatatcacaggatcatctacttattgtttactttttttcttatgccccaaaaagcactttgatgttaacttgtaagaaaatatggaattatggatattcttccaatggcaaatgcctttgttactacacattgattctctatttccattactttctatgcataaaataacattttttcaatatggaatcagag

SEQ ID NO: 58484 - DNA, 3571 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacaacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaa

SEQ ID NO: 58485 - DNA, 370 bp, Homo sapiens
ggagaggagtgagaacgtgcagggcctgcctagcttgcgtgcttgaggaaggtggcattccgtgcttgcctccttgaggagggtggcattctgtgtcttctgcttatgaagcgcctttcttaagcagaagacacagaatgccaccctcctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaa

SEQ ID NO: 58486 - DNA, 751 bp, Homo sapiens
ttgggaggagggttaacaccaggccagaaaccacgtgggcagggtggccctgcactgggctgcaggtgcagggcacgagcaggctgtgcgtctgcttctggagcacgaggctgctgtggacgaggaggatgcggtaggggccctcacagaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggcacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgg

SEQ ID NO: 58487 - DNA, 3721 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacaacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaa

SEQ ID NO: 58488 - DNA, 2941 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggcccctgctgcagagagtgcagaaccgtcccaggcaccctgttctgagacttctgaggctgcccccagggagggtgggaagccccctacaacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaa

SEQ ID NO: 58489 - DNA, 3787 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacaacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaaaaaaaaagaaaataataaaaatagaagaaaaacaacgaggggaatataggtgggagaaaaaggata

SEQ ID NO: 58490 - DNA, 3611 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacaacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgccctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaa

SEQ ID NO: 58491 - DNA, 1315 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggagtttgggatgaatgcgcttctcctgtctgcctggttcggccacttacgaatcctccagatcttggtaaactcaggggccaagatccactgtgagagcaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggcacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgg

SEQ ID NO: 58492 - DNA, 1519 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggagtttgggatgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggcacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgg

SEQ ID NO: 58493 - DNA, 1314 bp, Homo sapiens
agtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggagtttgggatgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatcagggtgcctctcctctgcacctcgctgtgaggcacaacttccctgccttggtccggctcctcatcaactccgacagtgacgtgaatgccgtggacaa

SEQ ID NO: 58494 - DNA, 640 bp, Homo sapiens
tagctgcactggcagctgactagatggtgcccacccagattgagggtgggtctgcctctccccagtcccactgactcaaatgttaatctcctttggcaacaccctcacagacacacccaggaactatactttgcatccttcaatccaatcaagttgacactcaatattaaccatcacatttcctaaaccaatataccaattattgattatgattatgacaatcatttcacattgtatacatacatgtatcatcacactgtacatctcaaatatatgcaagttttatttgtcaatcatacttcagtatagctgagaacaagttaaatggaacaaataaaccatgctttcaaaggagccttggctaccaaaattcaaaaaagaaaaacatgttattaataggaaagtaaattccaaataaacatatatatacttgactactcatttaagccttctgtgaagaaaacccaagaaattatgggagaaagctataaaaatatacaacaaaatgattaaaaacattaaattttcatggtagacctcaaagttatttaactttcttctttgtaagtgtattctaagttgaagcaaggaatatgcaacagcttaaaattttataaattatataattttttcacagaat

SEQ ID NO: 58495 - DNA, 99 bp, Homo sapiens
acactagcaatggcaaagctttgtgcggaggcattgctggctgctctgaactaaaagcatccgtggggaccgaaagaggtttttgcacaccttattaag

SEQ ID NO: 58496 - DNA, 678 bp, Homo sapiens
gcccactgctcatcaaggtggaaggcagaactcatcagcttgtagtcaatgcagtacctgcaacaaagctgctccaatccagaatgcacccgagggagaaagatgtctgaagtcctcatagctgtctcatctgcaaagtgacttcccagcgggttacctgccctcggccctactgcaaaggaatcatcactgtggggtccagaacctcaggtgggtgtcagggccatccgtgggcactgcaggaatactcttccatggacagagttcacatgtcaccctcactgttggaaagtgtcatctatgggtgcagatatccgtggaagtgacatatctgctacctgctttggctcagggaagcatgcggggcgacatggaggcctccatgcagcctggtgtctgtcatcttgctggctgtgctgtgtttgggccaggccctctttcgggcctgcctgaaggtcagccaccctgtccagagcttctcctgagccccatgaggactcacagactgtgcctggtcccttcaagggagctgggagccagcagctgccatcctttctgggtagaggtgggaaggagctaggctgtgctcgggtctggggtaggcagagcctctgctgggcagccgctccctcaaggccgctgtgtttacagaaaagcaaaccaggtgttcttcctaaa

SEQ ID NO: 58497 - DNA, 1600 bp, Homo sapiens
tacaacactccaaagttatttttttttaacctaaagaaccctacttctagcacctcctctgaaagaatattttgctccaataccacgtgcaacaaacttatttagacagtatcaactctagcccttaataggttcaaggacaagtttactgcttcctttctacacgcttaagttacactctcttctcctgttctgatgactctaaatcttcagcctctcccagcattaatgtgtgagtcaacattgcagacctgagaaaggtttctagaatggtaacccaatgttctttagaactggagaattccattttccttttctggctttagtgttaatgtctgggaagggaggctcatgataagaaaataaaaatgagaaaagaagatctagttcataaaatgactataccccacgtaagtttgtaactgcacagtgttttgttgtacggctcagaaatgagcaagtgttagtattattaggcacacatcacgttcacagcttcgcgcagagacggatagtgtatttggatatatggaagtcatccaaatgcgttgctagaatatcaggcctatgtttgttctggtagaaccacagagactcacacaaagttctgaccctaccactctggtctgggctgagaccaccccaaaaaatcatctagagaatcaaaggggctcacatctcagttgcattctatttaaaagataaaggggccatactctccactgcaaagaagcattagtaaaacttcccgcacccaaattataatccggcaaccctagcttcagctaaaaagattatccccagaatctaaaagcttactattgttctttcttggagtccaaaatgcttagcagttctgcagttcacatacaaaactcaaaactctttttatcctgtattctgtgagttccttgatgatagtaattgggtcttattcatcactctgtatcctgtggctcacacagaatctggcaaattgcatatattcaataaatgttgaatatctaataacctccttattaatataacaaatattatcaacattctgtgcacatcaatgtcccatgctgctactgtagtcaggagttatttggctgggaagtggaaagtgttcacaaacatgatgcttatctaataaaatatcactgagcaataaggagaaatattttaaatagatttgaagttgtgaacaaataatttagagtccaaagaggaaaaagaaaattaactctgttttttatccctagaactcagaaactttactggattggtcaacaaagacaaactttttattgtataaaacagtagaattcatggaagggataattcttttggaacaggcttctcggttacttgccttagtaaaagaagtatctggagggcctggagagttcataaacatagttttctgtgcaagtgaagatctgtagtttggcttaaaaatccttgcatgtagttttgcttggcgtggaaagttattaggagacaatcctttatcctgttctgcaagcaatcaaacacatgatctcccttctagccattcctcatccagtacatgggcatttccagcctcctacatgtaacacttcaaacttcctct

SEQ ID NO: 58498 - DNA, 408 bp, Homo sapiens
atccaaaggatataggcaagcatcagatacagccaaagcattcttttcctaaaagagtctgaacgcatctgatgcaacacccaaaagtatcccttttctcctcgttacagtatgttttggctttggaataaatgattagttattgaacaatatatggagaaatatcttacaaaaggaagtcatttccattttctaacatcttttacattgcactaattacatggtttaaatgactatccctaatcttcatccaactacaccccatgaattttaggtttatttaatcaacctagttagaccagatatatccttctaaaatcatttgtagatagagattctccttttgctagtaaataccattaacatatttacagaaggtctggtctaggtcatttattccaggcctct

SEQ ID NO: 58499 - DNA, 524 bp, Homo sapiens
cattatataatgataaagggatcaattcaacaagaagatatagcaattctaaatatatatgcacccaatactaggccacccagattcataaagcagatactgctatacttaagaaaacagatagtaatacaataatagtggataggggacttcagccccccactgacagcactaaatgggtcatcaagacagaaagtcaacaaagaaacactggacttaaattggactctagatcaaatggacctggtagaaatttacagaatattcacagcagccatagaatatacattcttctcattagtgcatggaacagaacaccaatgaagtcactgatgacaaaagcaaatggacaaacattctaagctcttggattgtaagagcttaaattaatatggttaaaattgccacctacatattcagtataattcctatcaaaataccaaggtcatttttcatggaattagaaaaaataatctgaaaattcatattgaaaaaagcccaaatggtgaaagcagtcttaagca

SEQ ID NO: 58500 - DNA, 523 bp, Homo sapiens
agctccaggggtcagggagggggactcaggagggcttagctcagcagtgatgggcacagcatgtgcacaggctcagcacacatggggcctgccccaggccctggagggcacggaacaaggctccacaagaaaagaaaaaaaaagcagggggaaccaggagaccctacagtagggataatggggaaaggaacacaaaattgggtcaggttgcgtttattgatacgggcccactaagcagaggttctggacctcgtgctaccactgctggggtttgactggttggttggtgagctacaacacagaccaaaaagtgacctacacaaagtgaggctgaaatgccaggcctgcctctctgcgtggcagaggatgggactcaaaggcttggggaggttggagtgtcagagtggatttatcttttgagacctactcacccacccctggagaggagagaggacacacctcttaccacccccacgagaaataaatttgtgaggggaacactcctccttcatgaaaaaaaaaa

SEQ ID NO: 58501 - DNA, 246 bp, Homo sapiens
gtgaggtagtgtcagaagatgatagggctgggagcaactgcagcagagtaatgatgctaggatgtgtggaggaagctccaggggtcagggagggggactcaggagggcttagctcagcagtgatgggcacagcatgtgcacaggctcagcacacatggggcctgccccaggccctggagggcacggaacaaggctccacaagaaatgcaccattttcccaatttatacccacagaaatccggggag

SEQ ID NO: 58502 - DNA, 414 bp, Homo sapiens
ttcctgcgccaatcaccaccaatatcaattgtgtgagcttgggtgtctgtggggcaagaggctgcaatattccatcctgggtgtctgggctgctaacctggcctgctcaggcttcccaccctgtgccctgggctgggcacagccccaggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgcgtgagggtggtgggcctgcggggacattcttactgtgctaaaaagccactgcaaacatagcaataaaaacctgtcattttccaaa

SEQ ID NO: 58503 - DNA, 391 bp, Homo sapiens
gtcttggaagaatctctatcccaatctatcagatcactttttgctctacttccctccttcccagcctgaagtctaacagttcaacatttcaacaaatctatcataccctaactctcctgctcatctgtctttcactggattaatctagaaaaaccctttgtggcttcaagctttcattctccttgagctcctactgaccacggccctccctcaagattccataaatacccaacaagtgtctgcaatgcaccagtgacatagcatttaaacacactgtattttaacaaactgctgacttgtttattacaaaatatttattacaaatgttcaacagatatttattgagcatttcctaagaacagaaaggcactattcttaactgtgagaattt

SEQ ID NO: 58504 - DNA, 187 bp, Homo sapiens
cttttgaaaaataacatttattggattgttcctgattatgaatttaaaatatcattgaagaaatcttgcaaaacaaaaaaaagccaaaaaattaaatctcccatatcaatcttaaattcttggcatatttacttctggtaaatattacttctggtccttattctatatgtgttattgaaattgtgtt

SEQ ID NO: 58505 - DNA, 326 bp, Homo sapiens
ctgagaggctgatatggcaaggaatgctgtctcaagagaagatgccagcgggtggccgctgtcctggcctgtggctcttccctgctcccttcaccctctcaggaccagtcacaggatgggggccagcctcccgctccctatatgcccatcagtccccgaggtgcggggtgggaacttggagagcaccgtgctgcatggaacgctcttgtcaccagcaaatgcctcagtggctatgtgggaacacaagactaacccctcccaaagaccagcaacctggcaccagcccatcctctccaaggttctgctttcaggaagctctgagggca

SEQ ID NO: 58506 - DNA, 313 bp, Homo sapiens
  misc_feature (223)..(223): n is a, c, g, or t
gggattgggattgtgtggctctgaggctgttaagtctggactgatgctggaaactaatatcaatgtttaacagggttgactgtcattaatgatgtgcctagctgtgggtacagatgctttgcacattactaccctctattctcacaatcttccatgggggatgtattagaatccccttttataaaggataaaggtgagggtcagagagactaggaagcctgtncagggtgacacaatacaaagtgtcataaattgggtttgtactcagccactctgcttattaacatcagcagtatggttaatggggtgaccg

SEQ ID NO: 58507 - DNA, 378 bp, Homo sapiens
cagcaatttttgtgaagcaatctccaaagcttgtaggtttcatttgtttaatatttcagggatgtgtaacaatgtggttggctccatggtcacactcttgagtcttgcgtgagtcatttctcacttcagttcctataatagtctcttgttcgttccctcaacctctctgttctccgcctgaaatcgatttacaattctgctgctcacttaatttatttagtgctttttattgatttatgtcatagaactgaaacgtgcatagatcagagcatgctgagcagagaggggagcccctctccacagctgcttccacagctgcccaaactgacatctgagctaaaaacaggtcaacctactggctgcagccggaatacgcca

SEQ ID NO: 58508 - DNA, 594 bp, Homo sapiens
aagctgttaagagttaggaaacttgaaacttaagcccaaaacttttagggatcgtccagcaaaactcaacatatgaatcacctagattcaggtcataaaagagaatacttattttgaaaagaatttgaaaagaaatgcttcattcacattgatacccttatctacacacttttttggtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttc

SEQ ID NO: 58509 - DNA, 216 bp, Homo sapiens
ctgaagaaacaaagaaataaataatactccaagttagagagtggtacacattttagaaaagtttacaggagcaaggtaaggaagactgggatgctggagtgggaggaggatattggtgcaatttcaaatgtggaagaaggaggtcagtgtatcccactgagtaggtgacccacgagccagagactgaagtgggtgaatgggtagcattctgggcag

SEQ ID NO: 58510 - DNA, 291 bp, Homo sapiens
aattacctacttctaaattgaatcattatccccaaagaaaagtgctattagaaccctgcagactccaggtcatctgcaatatacatccaatctcataaaaagaaataacaaaaggaaaaaataaagggaaaaataaaaaccaaaataaaaggtacacctcattttattttattatgttaatttaatccccaggtagaaagaatgagcttctgttgtacttcaatgtttaaaatctggccaatttttaatgtttacaaaattatttttaattttaagagagtataatttacc

SEQ ID NO: 58511 - DNA, 419 bp, Homo sapiens
aagacaaggggcagaggcagagagagagagaggagccaccctgagaaggaagagaccaggtgggctctgagacagggagaccctttctacgtcggtgccttgacatgtgacttttttgtcacttcgtgctccaggatcacacctggatgaactatcactttcaaatgaccttgtcttttctcgggccttccgaactgatcatctcttccttctgatacaagaggatcttccctggaagaccactgcacaccttctagtaacactgggaccctggataatattctactttgaagaacaccagtagaccgaagcaagatgacgaatttttaatgccaaagtatgcaaaacctgccacttcactggcaagccatgaattattcataaatatagacttggttaatatctttaaaaatgcagca

SEQ ID NO: 58512 - DNA, 539 bp, Homo sapiens
aagacaaggggcagaggcagagagagagagaggagccaccctgagaaggaagagaccaggtgggctctgagacagggagaccctttctacgtcggtgccttgacatgtgacttttttgtcacttcgtgctccaggatcacacctggatgaactatcactttcaaatgaccttgtcttttctcgggccttccgaactgatcatctcttccttctgatacaagaggatcttccctggaagaccactgcacaccttctagtaacactgggaccctggatgcatatttagaaaaatctcagcacatctctgggcaatgaaatcattcttttgggacctgacacatgaactgaagtgtaattggcattcttcatggaaggggcatggatttaaattgtcataatattctactttgaagaacaccagtagaccgaagcaagatgacgaatttttaatgccaaagtatgcaaaacctgccacttcactggcaagccatgaattattcataaatatagacttggttaatatctttaaaaatgcagca

SEQ ID NO: 58513 - DNA, 504 bp, Homo sapiens
aagacaaggggcagaggcagagagagagagaggagccaccctgagaaggaagagaccaggtgggctctgagacagggagaccctttctacgtcggtgccttgacatgtgacttttttgtcacttcgtgctccaggatcacacctggatgaactatcactttcaaatgaccttgtcttttctcgggccttccgaactgatcatctcttccttctgatacaagaggatcttccctggaagaccactgcacaccttctagtaacactgggaccctggtctccatcactctctgctgcctggtaactggtattggacacctggacatctgcatccccgagccttgagaacccaacacgtgttctggaatgactggcagtagcaccccaccactcaacccccatatgagaagaaaaaggcctcctgcctcctcttctttcaccagacactgtgggcccacaattcccatgtgcaccccaaagatccaagccactagctctctctccacc

SEQ ID NO: 58514 - DNA, 609 bp, Homo sapiens
aagacaaggggcagaggcagagagagagagaggagccaccctgagaaggaagagaccaggtgggctctgagacagggagaccctttctacgtcggtgccttgacatgtgacttttttgtcacttcgtgctccaggatcacacctggatgaactatcactttcaaatgaccttgtcttttctcgggccttccgaactgatcatctcttccttctgatacaagaggatcttccctggaagaccactgcacaccttctagtaacactgggaccctggatgctgctggtgctgggtagagaagagaccttggaacacgctgctgactgcatcatctgaaacaggaggaatcaagccaggggctggaataacaatcccaggattccagtggacagactctcaggatgattcctctaagaaccacagcatctcctgcccgggggaaggcccattgaaatcaaccaagccccacacagactaagagcagtgcgtttgggtttgtggaatattgtggttggaactggctgcttcccaaaagtttacggtcctgcagccacagaagcacgcctatattgggatggtatgagataataaacaacgcatgatgtattttc

SEQ ID NO: 58515 - DNA, 493 bp, Homo sapiens
tacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttc

SEQ ID NO: 58516 - DNA, 805 bp, Homo sapiens
tagtagagacagggtttcaccatgttggccaggctggtctcgaactcctgacctcaactgatccgcccacctcagcttcccaatgtgctgggattacaggtgtgagccactgcaccccaccagagtgtgagttttgatctccaacagtatgcattttctagtgaaattcggtttaataaaatgaataatgagataatagctaacatatattgagaacttcccatgtgtcaggtagtgctctgggtgtttagggtattctattatttaattcttaccacaaccctatgaggtgggtactaggatatctccagtttacagagaaaacaaggtgccagagagattaagtaaccttgtctaaggtcacacagacaaggagtgctggagcctaggtctaagccagacagcactagatcttcatgactttgtcacagtgcttcaccttggagaataatgagatgatgctggtatgtagacatgctaaggaggtcttccttgcctcacagtcctgatcaatatggaggcttttatgtagttctgtttgcgttcattcttccaatgcaaagctggagtttacctagtgggataagatttgattttcatccttgagaatgagttgttcttcaggctggcccatgagtcttcatcctgtcagcattctgattacatttctcattatcattctcctgcagtgattcatgagtatgataaaaccgaacagccttctcagtaaataagcaaagcttagcttacggggaaaaaaaaaaaaaaaaaaaagtagagctttccttgaatctggagaaattaa

SEQ ID NO: 58517 - DNA, 870 bp, Homo sapiens
tggaagaaacagaaaatttttcagtgtgctaaccaaagatgagctggatttccatgggagctgaatttagggtagtgcatcttgtggtgttagcatcatgaagggaaatgactcagcttaagtcacgttcaatggacattgttcattcatttcacaaaaatgaacgtgtcggacactaggtaggagctggggatgggggatgcatgtgggttataacggtaagcaaaaactgtgaaagtatgaatgttagtacagtgaaagtatgaattgaaggcagtaatgtgtgggatcagagagagttttcctggaaaaggtatttgagctgagatctaaaaccttgctactcaaggccgggcacagtggctcatgcctgtaatcccagcactttgcgaggctgaggcaggtgaatcacctgaggtcaggagttcaagaccagcctggccaaatggcaaaaccccatctctactaaaaatacaaaaaaattagccaggcatggttgtacatgcatgtaatcccagctactcaggaggctgaggcaggagaatcacttgaacccaggaggcagagttgcagtgagccaagatcatgccacttcactccagcctgggcaatagagtgagactctgtctcaaaaaataaataaataaaacaaaataaaataaaactttgctactcaaaatatgattcatggacagtgtgcttgagcatcacctaagagtttagtagaaatccagattcacaggtcccaccccagacctaccaaatcagaccctgcattttaataagatccccaggtgatttatgtgtgcattaaagtttgagaagtgctgatctgaagcatcagtaggagttgaagtataaagcgttgag

SEQ ID NO: 58518 - DNA, 338 bp, Homo sapiens
ctcctgaccttgtgatccacccgcctcggcctcccaaagtactgggattacaggtgtgagccaccgcgcccggcctttttttttagagacagggtcttgctatgttgcccaggctggtcttgaactccttgtctcaagtgattctcccacctcagcctcccaaaatgcttgggattataggcatgagctactgtgcccggctttgtcttactattattgttgttattcttattgccatgattatttaccttcccctcctccacaaagacaattctgttcacagtgaattccttgccattctccaaatttccagtgtgctttcacacttctacccgctg

SEQ ID NO: 58519 - DNA, 424 bp, Homo sapiens
ggagatcgcgaattctcaggccccacctgctgaatcagaccttagagatggagtccaacaattggtgctttaacaagccctttcgttgggagatctcagtccacacttaagtttgacaaccactgatttactccaaactcttgattgcacaggtgagataaatgagaaccagaaaagtaaagtgatttgcttggggtgatccagcttagcatcaaaatcaggaccagaatctgggcctcctgactcctagtgccatgtatttgcatcttgaactggacttccttcccttctctgcaattgcaacctgagaagcccaggttaggtccaatcatcattgctttttgtctgtgccctcctatcctacatcagggaaagatatgcttcaccgaagcacctgggctctttcatttcattttggacagtt

SEQ ID NO: 58520 - DNA, 410 bp, Homo sapiens
attacctttttataacccaagagtgccattattacacccggaaccctcaccaaataagtaggaaaactacactgagaacaattcggcccagctgtctctggcccatttccctttctaccgcctcttgtgcattccagcaatctaactcgatgaatgatcttccagttggaaagatggggacttcacaatgtgcagacccaaagatctgtcttccaaaggccaatcaccactgtatccttcgttcctttaaatgtcgttgtttatttgaatatattaagaataatatcaaggtaattatctatgtataaaatgtatgtttaattttttaggaaccatcatactgttttccacagtggctgtacattttacattcccaccaacaatgcacaagggttccaatcgctccatat

SEQ ID NO: 58521 - DNA, 552 bp, Homo sapiens
caggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtg

SEQ ID NO: 58522 - DNA, 363 bp, Homo sapiens
ggaggcagaggttgcagtgagccgagataacaccattgcactccagcctgggcgacagagccagactgggtctcaaaaaaaaaaagagtgctacatggctcaaagccggagcaaataagacggccaacagaacatcagtatgtaagttaaatgttttatttctttctaatcttatctgaacaatataggcagagatggactgccaaaatatgttgtggggatcagggtagaagacagtttaagtttttcattctggtaacttgtccacataacccaaattcatttcttgctgttaaattccgtgtcttatactagagtaaataaagctgaaaatctcattagataacacgagggagttaaggt

SEQ ID NO: 58523 - DNA, 368 bp, Homo sapiens
tctatttcaatagcttttggggtacaagtggtttttgattacaaggatgaattgtatcacagtgaagtctgagattttagtgcacctgtcagcctagtagtggacactgtacctgatctgtggctttttatccttattcctgctcccacccttcccccttctgagtctccagcgtccatgatatcactctgtatgcttttgtgcacccacagctcagctcctacttagaagtaagaatatggtatttcgttttccattcctgaggaaaactcatttctgtaaactgctgggggccccactggaagactcaggagcccttttcaaggcttttcatcggtgctgccatggcttctctcgggagccttgga

SEQ ID NO: 58524 - DNA, 211 bp, Homo sapiens
attgcaaggcaaataagtggagaaggtttcaatgacatgaaggaagaagatgtggaggaaattttgtcagagaaggcagtagaacccacaaacaaaaacctggatgagatggcaaaacatgggagcatagtcagggatgaaagtcaccctaagactccaagaattgtccttctcacagcagccaaaatatcagaatagaattctgccttgg

SEQ ID NO: 58525 - DNA, 418 bp, Homo sapiens
gcagaaaagatgaaagaaagcttcccatcagtgtttcaaataaagaagtttatgatgagatgttaccattgaccccttaatttctgccccgtttgaaacacctaagggagtccaaccattgtccatgccccttttggaatggttgtgatttcccagggccttggttaactattactcctagcccaaatcctggtgagctccactagctgcagaggccaccatttgcaagagcagatatgcagaagatccctggccagcctcctcatacctaccttcattgctatgtggagacaatagaatcattaaaagttatgggctggacatggtggctaacacctgtaatcccagcactttgggagaccgagatggatggatcgcttgagtacagcagtttgagaccagcctgggcaacatgatg

SEQ ID NO: 58526 - DNA, 369 bp, Homo sapiens
cttatctctgacctcaatcttccatcttgccacttctcccactcccaaaccatctttttcttggccccagtaaaaacctccagtttcttgacccttccattttcttccaatgcaggccactgttgattcatcaattcttacaacatttatggcaaatcttactagtctctctcttttcacatttcatatggtacttatttcaaaccttagctattttcaggaactgtgaaactactacttctgcctatcaccctcagtaaataaatttcaattccctatatgaaaagaaagctataattccattttctgctgttttaccattttatttgcacactactatctttccctacccaaccaatgcatttatcc

SEQ ID NO: 58527 - DNA, 113 bp, Homo sapiens
tcctttcctttcctttcccctttcctttcctttcttttccttttttttgagacaaggtctcgctctgttgcccaggatggaatgcagtggcgcaacttcagctcacagcaacc

SEQ ID NO: 58528 - DNA, 1237 bp, Homo sapiens
ttggctggtctccctggctggccggacccgccgccttccggccagcgcacctccgctgcgtggaagcggccgtgccatggcgccttgcggccacgagagggcagccgcgggccgcagaaacaccaccgcgcccggcttcccgagcctgcgcctgcgcagacccgaggccgacccgaggcggtcgctggccaagcgcccggccagcgcttccggctgccgaggctgcagccttcagtgagctgtggctctgccgccccgggagggaacaaatggcggatttcaggcctccgggccatgcagcctccctctgaggccccaaaggcgcgatagaggcggtgagatgcggctggagctgggaacgaattccccggccggcggggaggccgcccagcccggtgcgctgaccgcactcgccttgctttcacccctcgggtcgcctctcgcacctcgcagccgaaagcccctccgctgggtcacgtttctccatcccgctgcagcctgagcaaggtcgccttcatcctttacagacagaagttcctctacccggaggcccggagcctgggagagggccactgggaacgtcgcatttgcagagccccagtaaccgggctgtggaccgtcttcttactgcttgaagtttcaggctcagagcaggaaacgattccagagctcagccaggcaccgatgagaagaaaaacagaagcagcacattgcccagggccatggagcttgccagtgaagagcaaaccaggccacgtagggccgctgcttgggaccctgtcctggcacccccagctcttggagaaagtcagcgctcccaaggcctccaggcccgccagcatcgtctggccctgactgctctccaccataccccactctccactgcagctcttccccatgtcccggctgtgcacatccggccccatgatcccagccgcgcccagcttcactctctgcccagcaaactcttgcttgtcttctaggtgttggcttagaaaacattctccctgcaaagttttctaggcgttccccgcacctctcacacaaccctatgcaacactgtattccagggtagcccacacagaacctcacctgcttgttcacttatctgacccagaatacgaaaggcccacactaggtcttaattaatatgtcccctacatcccagctgccccttccaagtccccagtttctgggcccatgtactttttaccgtgttgcccactggccctttcac

SEQ ID NO: 58529 - DNA, 1523 bp, Homo sapiens
tatcccggggagtgactgctaatgtagtatagggcttctttttgggtgataaaaatgttgtaaagttgattgtggtaaaggttatacaactccatgaatatgctaaaaagtattacattgcacattttatttatttatttttatttttaaaaaaatagagacaaggtctcaccatgttgcccaggctggtctcaaactcctgagctcaagcaatctttccaccccagcttcccaaagtgctgggattacaggcatgacattgtatattttaaatgagagaattatatctcaataaagctgttttaaaaagatatataaccacataaaatatcaagtactcatgatttatctaataaaagactgcaagacttctacatagaacactataacatattattgtaagaaactgcagaactaaataaacagagagctatgtcatgatcagacttagaagactcagtaaagttgtcattctctctccaattgttctatagattcatttcactaccaggtcaaagacacaatcaaaagcccgacaaatggaatttgtggaattggaacaaaaagcttttcttcctaggcacaagaacatcaaagcataaatccttcaggtatcagcaatgacatcacttaagaatttctcagaatctttggcaccaccccaggcctaccggatcagaatctgaattttttaacaagatctcagatctagtcaagagtccagtctgatttctctttattgggactaccacccaaagcagaatgaggatgatgtaaccacgcccagtgacttctggataccactgactctaggcattttgcagatcctgaattccagcagaatggctgacaccaactggtctgaagaccctcaccaaggaactgactcagtgcaggaatgcagtttcttcatctccctatccctgacttcacccctcacttctcaaccaatcagtgatcaccacactttaggccatcacctgtgtccagaccccttaaaaaccccatctgcaaacctcttgaagaggcatatttgaggtttcctctcatctcctcatttggtttccctacaattattaaattctttctctgctgcaactcctactttttcagtgtattggtctgttactgtgcaacaggaaatcagacctggtggtcctatagtaagagttcacagaatatgatatacaaagtgatctgtgatatacaaaaaccggcacaatctcactcttaataagaaaaattcaacttaaaattaaaagttttttttcctcagaatggcaaagatcaaagtttgataacatggttggaaagtatgcagaccgatattctcatattcattgatgaagtgtaaattgatacatcctttgtcagtacggacaggtttcccaactctaggggtgaaatttatacagactacagtgtgaatgacaaccacttcaaattgggtgatatgatgaccttgactctgtggagggtcatttggcaaaatatctcaaaataaaaatgtacatacaatttga

SEQ ID NO: 58530 - DNA, 1146 bp, Homo sapiens
ttaagcgttgtgcgccgcggccgggcgcggtgattcacgcctgtaatcccagcactttggggggccgaggcgggcggatcacgacgtcaggagatcgagaccattctggctaacacgattcatttcactaccaggtcaaagacacaatcaaaagcccgacaaatggaatttgtggaattggaacaaaaagcttttcttcctaggcacaagaacatcaaagcataaatccttcaggtatcagcaatgacatcacttaagaatttctcagaatctttggcaccaccccaggcctaccggatcagaatctgaattttttaacaagatctcagatctagtcaagagtccagtctgatttctctttattgggactaccacccaaagcagaatgaggatgatgtaaccacgcccagtgacttctggataccactgactctaggcattttgcagatcctgaattccagcagaatggctgacaccaactggtctgaagaccctcaccaaggaactgactcagtgcaggaatgcagtttcttcatctccctatccctgacttcacccctcacttctcaaccaatcagtgatcaccacactttaggccatcacctgtgtccagaccccttaaaaaccccatctgcaaacctcttgaagaggcatatttgaggtttcctctcatctcctcatttggtttccctacaattattaaattctttctctgctgcaactcctactttttcagtgtattggtctgttactgtgcaacaggaaatcagacctggtggtcctatagtaagagttcacagaatatgatatacaaagtgatctgtgatatacaaaaaccggcacaatctcactcttaataagaaaaattcaacttaaaattaaaagttttttttcctcagaatggcaaagatcaaagtttgataacatggttggaaagtatgcagaccgatattctcatattcattgatgaagtgtaaattgatacatcctttgtcagtacggacaggtttcccaactctaggggtgaaatttatacagactacagtgtgaatgacaaccacttcaaattgggtgatatgatgaccttgactctgtggagggtcatttggcaaaatatctcaaaataaaaatgtacatacaatttga

SEQ ID NO: 58531 - DNA, 1452 bp, Homo sapiens
tatcccggggagtgactgctaatgtagtatagggcttctttttgggtgataaaaatgttgtaaagttgattgtggtaaaggttatacaactccatgaatatgctaaaaagtattacattgcacattttatttatttatttttatttttaaaaaaatagagacaaggtctcaccatgttgcccaggctggtctcaaactcctgagctcaagcaatctttccaccccagcttcccaaagtgctgggattacaggcatgacattgtatattttaaatgagagaattatatctcaataaagctgttttaaaaagatatataaccacataaaatatcaagtactcatgatttatctaataaaagactgcaagacttctacatagaacactataacatattattgtaagaaactgcagaactaaataaacagagagctatgtcatgatcagacttagaagactcagtaaagttgtcattctctctccaattgttctatagattcatttcactaccaggtcaaagacacaatcaaaagcccgacaaatggaatttgtggaattggaacaaaaagcttttcttcctaggcacaagaacatcaaagcataaatccttcaggtatcagcaatgacatcacttaagaatttctcagaatctttggcaccaccccaggcctaccggatcagaatctgaattttttaacaagatctcagatctagtcaagagtccagtctgatttctctttattgggactaccacccaaagcagaatgaggatgatgtaaccacgcccagtgacttctggataccactgactctagatgagcaaggagagactcagaggaagtcagcgttactcgattagaaagtgactgtggcactaccatagtagtaaaatctaccatggcagagaaaatgccatatgttcaccttgccagtcgtttttctttttcctcctgggtttataggaagatggcagcccctggctcccctgcaatcaggcagggccatgtgactgagtcttagctcaccaatgtgggagaaagtgatgtgtgacacattaaggccaggccactgaaacctctcatgggaacttccatactcacttccctcatctgctagccaacccaaaagattgagtggaggattttacagccccagggcctagagatgctggaaagaagcctgattcagccctgaatgaacctgtgcaaaggtgcctctgacctccaacccttgttggactaggatgttggaaaatactgtgttaagctactgggatttcaaagttgtttgtcatagcagctagccatatttactctacctgatagatctatgttctgtaattacagtgtttgcctttcatgtcctaagggtaaataagtgatatatgcaacaataaactgtgatgtactatatattgtttttattacattaaaattcttaaaatttgctttttc

SEQ ID NO: 58532 - DNA, 5874 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58533 - DNA, 414 bp, Homo sapiens
tctagctttaaaaaataaaacaataaacataaatgagcctattgagttcaatcagagtagggagcagttttattgaacagcacattttcaaattcttcagttgtgttttgtttttcagctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggtaagagtcctgctccc

SEQ ID NO: 58534 - DNA, 4982 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacggagtctcgctgtgtcgcccgggctgcagtgcaatggcgtgatcttggctcacagtaacctccacctcctgggttcaagcagttctcctgcctcagcctccctagtagctgggattacaggtgcacaccaccatgctcggctgattttttctatttttagtagagatggggtttcaccgtgttggccaggctggtctcgaactcgtgacctcataatctgcccaccttggcctcccaaagtgctgggattacaggcgtgagccaccacgcccaggttaaatgtgtttataaggagagaggaggccaggcgcgg

SEQ ID NO: 58535 - DNA, 3133 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccaggtgagggacagcgccgctgagcaggtgtagtctgcatccctccattttgacttattcaaaagagcatccccgtccagggcaacatggcaagaccccatccctttaaaagcaaaataaagcatccaagcctgacttcat

SEQ ID NO: 58536 - DNA, 3175 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggtgaggggcctggggagaagggaccagtgaagtaggtgacacacctgtggatggcagtggtggtgacagtggtggtgtcagtgcgggaccatagccacagagtacagtacatgagtgttcagggaggggacagcgtctagtgagccctgtctgagcagtcgttccgtttacctacgtgttcacatgatttccttccgtacatttatgaatggtttatcgaggagcctcaactcactgaggcccagcctgtgtcactgggatacagcatgaa

SEQ ID NO: 58537 - DNA, 2825 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggttggaagttaacacgtctttcacctgtgtgcttttagctgaaatgtattttgctgtatagatccacatcatacttgacttatttttcatgggattatgcaaatgagcgtcttgattccttttggttttttaggttagttttggggtggatgacagaagccctccatggagaggtggaattgggtggcagatactcttcctgcccctccatcctctgtcagaattgatgtgagctgctgctgaggtttagggagggaccaggggctgtgggcccagagctgctctcctccacagctctccagccaccttcagaggcaaaggagaaaaatcagcttgactat

SEQ ID NO: 58538 - DNA, 5700 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58539 - DNA, 5676 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58540 - DNA, 5372 bp, Homo sapiens
tctagctttaaaaaataaaacaataaacataaatgagcctattgagttcaatcagagtagggagcagttttattgaacagcacattttcaaattcttcagttgtgttttgtttttcagctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58541 - DNA, 4866 bp, Homo sapiens
gcatagccacataaggaataggcctaatgacaccttgtgagcatgtttattaaaatcaggcttgatgcttatttctaagcaataaactaagaaaatatcagagatcttgtcagaaaaaaagatgtaatagcctttactttagtagtctccatgtcagttgaactgaaattgctaccagtaaacagtcattgaggtggaatctaccttgcttttttttattaggtctgtaatgagtttagaaagtaatagaaagcctcatctaatcttttcaattacatcctatttgttgtataaattattctaatctgatgatactgatatttagcaaaataacatctttcagatcaggtaagtaagcgcagtaagcctgccagtgagagttgcactggagaatgtgacctatggagctccccagcactttcctctctccttcactcactgcaggcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58542 - DNA, 4446 bp, Homo sapiens
gcatagccacataaggaataggcctaatgacaccttgtgagcatgtttattaaaatcaggcttgatgcttatttctaagcaataaactaagaaaatatcagagatcttgtcagaaaaaaagatgtaatagcctttactttagtagtctccatgtcagttgaactgaaattgctaccagtaaacagtcattgaggtggaatctaccttgcttttttttattaggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58543 - DNA, 4337 bp, Homo sapiens
  misc_feature (16)..(16): n is a, c, g, or t
  misc_feature (91)..(91): n is a, c, g, or t
  misc_feature (108)..(108): n is a, c, g, or t
tagttaaactgtcttncgcatagtgcaagtttttgaacaactggaaatattttggcttacgcaaggttaatagcaggtcattttgtggaangcgtgggacaatcctancccttgttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58544 - DNA, 3994 bp, Homo sapiens
cagagctcggtacccgttcgctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58545 - DNA, 3923 bp, Homo sapiens
cagactgagatctctgcgctcgcgtcacactcaatttatcagaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58546 - DNA, 3873 bp, Homo sapiens
agaagttactcagttactcggtacgtaaataagtaaatatgtcatttgaaggagccacgtgtatgggaagccccggcgtcctggctaagaaagaacacaggttcccgcattcagatcccggctgctccactttctgccagtgagacccttaggttcccaggctgcaaacggaataacgatagccgtgaggacacagcgggtttatctatcaatagacaccaatgaaatcaatggaaaagacttattctaacttgttattagtcttagtgaatattataatttataagaaatatagttgatatgccataatttgtctcccagtttctaagattaccctaacaagctgttctaatggaaaaataattttcttaccaggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58547 - DNA, 3842 bp, Homo sapiens
caccactcaccttggcctcccaaagtgctgggattacgggcatgagccaccttgccagccagtagaaattctaaaacaaaacccagaaatgtgctttcgtgatgaaaacatatcttcaacaggctctcactcactcacactgcagccctttgcccctgacctcactgtttctgtgtcttaggaaaaagaaagtgatgctgtgaagccaaagaatcagggtatgtaaagaattggggtgcacaaagaactggggtgtgtaaagaatcggggtgtgtaaatgcatgtcatggaagctccatgtgggaacggcttctgtccattcagcaagtatcactgcacgcctgctgcacctcagccatctcccagctgaatggaaaacatgctacctttttacttgtataatcgttttagagctcacatcaaactgcttactaaaattttgaaaataatttctataaaaagttatttaaattgttttaatctcttcagacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58548 - DNA, 3058 bp, Homo sapiens
agcttacacagcgagtccttttgggtctcaggtagcgtgccaggtccgtctcgcctgattaacactctgtgtgcctcctctgctgcaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccagggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcggtgttgtttgtctgcttgtttgcgacagagcgagactccgtctcgaaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatacacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctccgcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgt

SEQ ID NO: 58549 - DNA, 2409 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggtgagttaactttggtgaagttgtgatgtcatc

SEQ ID NO: 58550 - DNA, 1435 bp, Homo sapiens
ggcacgagggttgtcatgagagtggaggctgcggccggggctatgggcagaggcggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacctagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacatacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgagcgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgcattctgcagtagacccgttactccctgccacagatcctcatccaaagatcaatgccccggcactgcagccaggtgagggacagcgccgctgagcaggtgtagtctgcatccctccattttgacttattcaaaagagcatccccgtccagggcaacatggcaagaccccatccctttaaaagcaaaataaagcatccaagcctgacttcat

SEQ ID NO: 58551 - DNA, 357 bp, Homo sapiens
gctgacggaatgtgacaaaaaagacgggtttggaaagtgttaccgttgcagtgaggctgttttcaaggaagagctgcccagacacataaaacacaaggattgcaaccgtgagtgccccttcccaggctcccgtgccctcgggtcaccaggggtcctcttggaggaagtgccactgctcttgagcctgtgcaagggcttggtgaattaaagggcacctgcgggcaggccagcagcatgtcttgtcgcctgtcattcagggagcgactgagtctttttaaaatcatttcagctgccaaaccggagaagctggcaaaccggtgtcccctgtgtcatgagaacttcagccctggagaagag

SEQ ID NO: 58552 - DNA, 2525 bp, Homo sapiens
cgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58553 - DNA, 4958 bp, Homo sapiens
  misc_feature (459)..(459): n is a, c, g, or t
  misc_feature (933)..(933): n is a, c, g, or t
  misc_feature (4158)..(4158): n is a, c, g, or t
tttgatctggatctggagtgagtaggagtttgccaggaagaacagggcatcttagacatggaaaacgatgtagaaacacccaaaacaggagacaactggactcattggcatgatttgatatggaggggacacggacagctgactagaaataacgtggatctcctcttggtttaatctcctctgcaaggagagccattgagggggtttcagtggagtgaggaaaggggtgtcgtgaggtgccttgtttgtactcacactggttgttctgtgaaacaagggttggagaaggagttactggaggtaggagaccagttagagggatgttgtcataatacaggtgatggatgttggggcctgaacctgggcaggggctatgggtttggagagaagcgaatgaattaaaaagatagaagaaaaatatgagaaattatggaaacagatcagtcaaggattactcanttctggtttagacaagtgggaggatggggcatctatctaacttaaagaaagtggaaggcagagacaattttgtgggcaggagatgaagttgggttcagagaacccatgggggatctaggcagcttcattatagggagacttggctgtggatatgaaaatgggctgcattttagggatttaggaggcagaattaatggaactattaatcagcccttggcagctgaacccttgaaatttggctcctccaaacagagcctcctgaaatgctagggaaacacatgggaacaagggctgcgaacctgggattttatccatgtagacatggccggtgtattgtaatgtacctccaacaacaacgacagtaacaatggctaacacatagagcttactatgtgccaggcatttttctaagctctttgcatatattaactcaattcatatatcctcacaacagaactctgagataggtagtantattattcccactctaaaacagaggctcattgttttgcccaaggaggtacagacagtaagtggtggacctgggtttgccataaagcggcagtcccagggctgactctgcctgtgtgtgtttaagattttaagtactatgacgatgctgctgatgaataccgggaccaggtgggtaccctgctgccgctctggaagttccaaaatgacaaagccaagcgcctgtccgtcactgccctctgctggtaagtataggcattgcagcaaatgcagagcccctgagtgccctctacatcccaaacccccagtacccccttctgcacttaaccaccttgagtatgacatgtgacagtatagaaaaatatggaacttggattcttatgggatcacaagaccacccccaggactcccaagtggtgagggcctaagctggagaacagatgtctgtagtatatttaggcaccagtgccaatgggaaggcccttgtccacaggagggccatgttcatttcctatgccaatggattcatatttttttttgcaggaatccaaagtacagggatctgtttgcagtgggatatggctcttgtaagtgatctgactattcatttatttgctcatgtaaacagcaaacactaagtacctactctgtgcagaactctttgccagttgtaagaaatacaaagatgactgcccgcagggggctcacagtctaatggggaagacccacaatcctactggcaattagtgctgggtgaaggaatattctaagctgaatgtgtcaatggaaccttgaaggagttattctggtgaagaaagaggggaaaacacttctggcagagggacctgcatatgcaaaggcttggaggcatgaggaatatggcagaatatgaagctgctgggggggccagggtcagccctcaaagggcctggtaagccattccaaaaagcttggatcttctcctgaggggaaaccactgaaggaattcaaggacagggacatgaccagtgcagggaggaattgcaggcattgcaggcctgagactggaggcaaggaaaccagttaggagactgatgcgggcatcccaaggagagatggcaggaccttaaccacactgtggagtagggatggagacccccccttcctgcctcctcctcaggccttcctgaccgggtgggtgggggcatgggggatgggatcccctgaaccttcggagcccactgctatccagagtgtgcccgcccctgccagttacccacccaaggcaggaaggcagcacaatggaaactgtgtccaggcgatttgctttcccttcatgttacttggtcccagaagaagcccctagcgctgtgctggcctggacattcccccttcccaacgggagagggccctacacttcacagtagtctcgctccccagtgctaacagcttgttctctggctgggaggatcagcttctgcaaacacaaaaacctttccattctccaagctgctgctggctggcaggcatacaagctcccagtcactgcccctcagactgcctgtccacccattctttgaccagggtggggaggggcagtgggtgtttgtcattcctctcagggaggagaccttggagctactcccagtcttgtggtctgggccgcctttgaggatgccctaaatgcctgctttgtgtccccactcctgagggtgggctgctgccaagtgggaagtgccctccccctctggcagggaactagcacattcctccccctctgctgcagctactgggcctggaacagggcctgggggttgggttgggcaggccctcccaggagtgggtgtggacccccctgtgaggctactctcaacccaggctctctgcccaggtctgaagcaggggtgtaggggttgctcctcagaaggtgggaggggaaactgcttcagttttagcgctattctccccgcacccaggttcggaagcaggctcagctggtcggggtcatgtggaggctgtcgtgggggctggagggctgggcagccttgggcaggagcagtagagtaggtcacctcccaccagcagaagaccttgagcctgacaagcccagcaatgtcctttgggcaggcacttacctgagaacggtctctttgtccttccttgatgctgttagctacatccacgtgcctgagtggtacccgtcgtcagctacagtcctgggggtgggggtgtcactttccagtgacacctggggccagaagcctctctgagccttggtttcttcgttggtgacatggaaaggctgacaacctgccaggcctccattccagggctattgtgaggtacgcttgagagagaagaagtaaacatgctgcaagcggaggaaccacctacacataacggacaatcattgctgatttgtctgtcattctttctcgtagctttcctgcagtaccctcagggagcccgagcagagaaggggggtgtggagacagaggtagtctcctagggagcagggcccagtggcagcagcagtggtatttgcttttgttgtcactggctctggggttgttggccggctttcagatgagcatctattctccagagccttgcatatctcagaaccacctgcagaggcctgaatagaaccaggctggctgagactcaggaaggcccctgcatccatcctgagcttgcctctgggagtcccatgctcttgagtgcctccatgggagaaagagggcgaagctggggcagacagaaggcaccctagctgctggatggggtcactatgaggagcagctggtctcaccagcatccatcacactgtctttggaagctcccagataccaccctcccataatcagcttttgcctcatgaggacaaacactggagtgagaatttgggtttgtagttggatttgactctggtgagctgagtctagacctcataaacctcctttttatggtattcccagatatttattctgtgactcagccaaataaaactttggcaggggtaggtatgtaccctaggaaggactgtagccattccctcatttctgggacaggccaggttggttggagccagccaggaacaagcaggtagagaaaaggaaatctgggcaattgcctgcaacagcacagaaacatccctacctgcttcccttctatagctgctgggtaccagctagtgagcacaataggctgcttaaagggcaaagattgggatccccctagggccaggcnacatgttcccagcagagtagagaaagaggctgtcagtaggtataaagcaggtggaggaaggttagaagaaaaggaactagcccaagaagagatggccttgggactgctgggatgcaatgatgtcagccggctgtactgaaggggtcctttccagcccattagccaattcatagcagggaaacagggacttctcatggtcttccaggcatggatggtggaacagatcaggatgctctgtgtggtcctgaggctatcacacaggagatggggcaagaagcttcccagagcgccatgtattggaagagcaggggagccagctgttccccagcccagcctctgtctggggacagcaccctcaaaaggggccaatgtcaggctctgagtcccagctctaaatcccttcccactctgtcccaccacatcctggcctgtccctgggcctgcccaggccagagatacacttttagggatttaaatctttcctgatcatttgtttgtcagcttcactaattaagcagtgttaatttcatttactggaaatggaaattcatccacctcatttcttctcattcatcctccacacacaaaatccatcactcctcggctgcgggctgcgtaaaatttacaagactaattatgttgtcaggtctctttgtaaatacagtccttaaaggccactgtgcttgctgggttgtaatgcaagggcattcctgttgttagtttaattactggttagttatttaggttctcaaatgtttgcctcattttccctaaatcaaattaaatgtcccgcttgatgt

SEQ ID NO: 58554 - DNA, 1293 bp, Homo sapiens
ggaagctacaaagcacatctgtcagccagggggttataggcccaagggtagacctgtttctggccaccctgcctaacacagaagcagaacttcagaacttggagaactcagctctgctccagccagcacagctcagagaaatggggcatccacactttcggatttgtagcccaccttgcctccttccaattccagctcaggctccagggggataaagcgaacacagcctagacattccctctcttcccccctcactatacgagctggctaggcctccacgtctcccacccggttgcctgacagacaagcgaggtcagggagccccctgggcggtggccagcaagcatggtctcccttaggcctagcctcggtgcacccgagttgccctcccccttccattccctccgcgccagcagcgatgacatcattcctccctgactccgggaccgcggacaggcggcaggatccgcgcccagcaaggacttcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaaaagcaatggagtctgggtttcattcctaaactgaagaggaagatcccagtcaactactggggacaagatgaaggtgaaatctcaaatgaaactgtaagggtaatttattccttgggaatcttcatcatgaaaatagttactattttattgaacattaatattgagcatttattatgtgtcagacactgtgttaataggttgtttttattatttttaatacttataattatcatgcaaattagatagtattagccttcttttatagatgaagaacttagggcttagagtggttaagcccaaagtcatgaagataagaagcagcagaataaagattcaaacccaactctgcctgcctccaaagaccatgctcttaaccactgcactgacttgtcttcccatacatctgagttactgaaagaagaagggctctgtggtgacttttaaatacagagcttcccaacctgtgtgatggcgatccttccagccctccaggggcagggagatctgtgcaactggaccccatgaactggtttcctctactgtgagtttaccgtagtgtgccatacaaacatagtttctatatggcttgaaa

SEQ ID NO: 58555 - DNA, 544 bp, Homo sapiens
ggaagctacaaagcacatctgtcagccagggggttataggcccaagggtagacctgtttctggccaccctgcctaacacagaagcagaacttcagaacttggagaactcagctctgctccagccagcacagctcagagaaatggggcatccacactttcggatttgtagcccaccttgcctccttccaattccagctcaggctccagggggataaagcgaacacagcctagacattccctctcttcccccctcactatacgagctggctaggcctccacgtctcccacccggttgcctgacagacaagcgaggtcagggagccccctgggcggtggccagcaagcatggtctcccttaggcctagcctcggtgcacccgagttgccctcccccttccattccctccgcgccagcagcgatgacatcattcctccctgactccgggaccgcggacaggcggcaggatccgcgcccagcaaggacttcaggcacgtaggcctaagatgatgggggctcttcccaaccagtgcgcacaggcagctcc

SEQ ID NO: 58556 - DNA, 2622 bp, Homo sapiens
cgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagtgaggggcctgttcctggctctgcctggggccctcccctgggctatggcactgtgagccctctgtgccatgggctttccaccctccacctctgcaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58557 - DNA, 2376 bp, Homo sapiens
cgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58558 - DNA, 2342 bp, Homo sapiens
cgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58559 - DNA, 2551 bp, Homo sapiens
cttggcttctgggagtgtttgtgaatgaaggggctttctgtatgcttgtccaagcagaaaagacactcccaagcctcatgtgaggtttttgtctaggatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaaaagcaatggagtctgggtttcattcctaaactgaagaggaagatcccagtcaactactggggacaagatgaagtgaaaacttcagattaactgaggatttggaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagtgaggggcctgttcctggctctgcctggggccctcccctgggctatggcactgtgagccctctgtgccatgggctttccaccctccacctctgcaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58560 - DNA, 2875 bp, Homo sapiens
ggaagctacaaagcacatctgtcagccagggggttataggcccaagggtagacctgtttctggccaccctgcctaacacagaagcagaacttcagaacttggagaactcagctctgctccagccagcacagctcagagaaatggggcatccacactttcggatttgtagcccaccttgcctccttccaattccagctcaggctccagggggataaagcgaacacagcctagacattccctctcttcccccctcactatacgagctggctaggcctccacgtctcccacccggttgcctgacagacaagcgaggtcagggagccccctgggcggtggccagcaagcatggtctcccttaggcctagcctcggtgcacccgagttgccctcccccttccattccctccgcgccagcagcgatgacatcattcctccctgactccgggaccgcggacaggcggcaggatccgcgcccagcaaggacttcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagtgaggggcctgttcctggctctgcctggggccctcccctgggctatggcactgtgagccctctgtgccatgggctttccaccctccacctctgcaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58561 - DNA, 2264 bp, Homo sapiens
gttattcacccaagcccctctttacttccccagctctgtgtcccaaacctccatcagccccagccaaaatgcttctctcaaagatatactgttggattaagtgagaaggagttgagggctttttgtgggtctcctgttgtcttgttctttaggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggtaagtataggcattgcagcaaatgcagagcccctgagtgccctctacatcccaaacccccagtacccccttctgcacttaaccaccttgagtatgacatgtgacagtatagaaaaatatggaacttggattcttatgggatcacaagaccacccccaggactcccaagtggtgagggcctaagctggagaacagatgtctgtagtatatttaggcaccagtgccaatgggaaggcccttgtccacaggagggccatgttcatttcctatgccaatggattcatatttttttttgcaggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagtgaggggcctgttcctggctctgcctggggccctcccctgggctatggcactgtgagccctctgtgccatgggctttccaccctccacctctgcaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccaaaaaaaacct

SEQ ID NO: 58562 - DNA, 310 bp, Homo sapiens
gatagagtgagaccctgtcttaaaaaattaaaaaacagccacagtggggtgaccaccctgagcttacagcaagccaggcattggggtcagcaccaaacacatatccagtcactgaatgctcacaacagcccaatctgcagttgaggaaaccgaggcacaaagaagctacatggcttgtccaaggccacacagctggcttgaacttcagcaccaccctgcccccatggaggcagtccacccaggggcaggggcctatggaggaggggctccccacgcattcttttagcggtctccccttagactggaaccc

SEQ ID NO: 58563 - DNA, 296 bp, Homo sapiens
ggaccacatattttctcctataaatagaaatttctgtaaaataagaaatacttgttagctctaagactcaacagaattgttttaatttgctttggaggaagaattaaaacctattttttaggcctatgttcattctttatttttatttattgattttttaaccagatcctctgaagacactaaagtgtagttgtctctgaggacaaaaacaaacgaacaaacaacaacaaaaaaacttcaccttaccttgctgacctagctatgaagttgctcttttatggccttcctaggcatga

SEQ ID NO: 58564 - DNA, 324 bp, Homo sapiens
  misc_feature (265)..(265): n is a, c, g, or t
  misc_feature (272)..(272): n is a, c, g, or t
  misc_feature (319)..(319): n is a, c, g, or t
  misc_feature (321)..(321): n is a, c, g, or t
agctatgaggaagggctgatggaagggaatgctcttcccatttttgagatgaagaaattgagattctaaaatgcgatagcgatatgacttgcttcatgtcaccctgacaagcaatggctacttggaactcattctaggtctctcaatccttgatcctcagacatagccatttctatcaaaccatgtacctgagaatgtcagattccccatgattaaaaaaattgataaatagaggggactgaaactgaaccccaatagtcccatngactgtnttgcttttgataactaggaaatggccacttcacagtcttaaacgttnanact

SEQ ID NO: 58565 - DNA, 408 bp, Homo sapiens
gggtcttgctatgctgcctaggctggtcttgaactcttcaactgcagtcttgacctcccaggctcaagtgatcttcttacataggcctcccaatgtgccaggattataggcatgaccaccatgccaagctccagatggtattcttaattcagctcacaatgtgccctcatcagattgctagtggccaggagtgaacaactgagtgactttaagaatcaggacaccaggaatatgttcctagaaagtgaaggtatgagtggaaaacctgggttggattatgaacaaggcccacatgtgtgccagagtggccagggcagggagcagcagcaggtgctggtgaaaggaaggtggattactggggcaatgccctgtctttgtgttatggtttctttgagggaagtagataag

SEQ ID NO: 58566 - DNA, 199 bp, Homo sapiens
aggagaggtagtgcctaaacttgaaaatcaaaaagtagtaatatctatttagacataaggagataaataacgaaataattgcttctatgtgatgaaactctgggagtacacaaggggactgctgttttactaaacaaattttcaagtatatatgactttgataaagtatccaaataaaataattcctttcccatataag

SEQ ID NO: 58567 - DNA, 216 bp, Homo sapiens
ctgatgggactcagcttctcccagctgttggctgaaggcctccgtttctcaccctatgtatctcttcatagtctgtctaagtagttttttgacatgacaactagagcaatagagagattccgggtgatgtcatactacttttatgacctagtttctattttacgcatgtgatttctgtttaattctattgactgaagttagtcaccaagtccagct

SEQ ID NO: 58568 - DNA, 184 bp, Homo sapiens
gtcaagttagttgatactgttgttcaaatcttctgggtctttactcattttctgtctacttgctctatcaattattaagaaagggatattaaaatttccaaccattattgtatatttgtctgtttttttatacttctatcagacataaagatgtaggactgtatattacccttgaagaatggag

SEQ ID NO: 58569 - DNA, 442 bp, Homo sapiens
tatttattaagccaatctttaaattattgaaaagagtggagaaaacgatgtgtttttatcgaggtaaaagttgcgtaacataactgtcacatagtcacatcagatttcaagtgcaattgagtggcattgggtacattccgtgttgtgcagccatcacctatgttgaagaagagagaaagtggttatttttaaaaagtgatgccggtctggactacagctggctggaattcagcacctattcaggaatgtgtcgataatggagtgcccacaacagctcacagccagcgataattgtctatccctttgtcttcatttccaagcgtctgaactgaaaaaagggaattagctttagctacgtttgtactgtatttccacttaaaaagttatggaacttgaacactgtataatgttcacccaaataaataagaacaatttacttgaa

SEQ ID NO: 58570 - DNA, 218 bp, Homo sapiens
agctttatcacattatacacaaacatagaaaacagtgtttcagaagagaagcaaaggccattggccttcaaatatttatgcaacaatgaaaatgttctcagcccttaaatgagcacttgtgacttgtccaaagtgagataactagtcaatggaagagttcaaactagagcatgtatcttagtctgttctcatattgctataaaggactgcctaagact

SEQ ID NO: 58571 - DNA, 2224 bp, Homo sapiens
  misc_feature (129)..(129): n is a, c, g, or t
  misc_feature (183)..(183): n is a, c, g, or t
  misc_feature (243)..(243): n is a, c, g, or t
  misc_feature (1630)..(1630): n is a, c, g, or t
gaaaattcacaatccagttttttgattccacactgcacatcccaccccctcaagaccagagaacacagggtctaggctaacacatcaaaagcagctctggagacttaattccattgtggtaatacagcnttcttactctggcagaagctccataccgttcagcaacccactgaacgtaggganggaatgggaagctcctgtgttccaaaagagttctgaactggctcttcatctgtcccttancccctgcattctagttttattgttcttctccccccagattgactatccatgttctggtcattcctcattgttaaatgtggttaacactttacataggcctctctgtggaggctgtgtagaaaattggcctgagcactaggagactggactgctgttgccccatgaaatgacagatctaaaaagcttccattcccagagatgttttcctactctcaataaaggcctagatttctttaggcctttttagaagaccacttgttttagactcaaagacttttctgggtttagcaatcttctattacagagaagagagccccaggacttttggctaaagaattctagctaagggccacaatgtacttctcgctagcattctcatagaacacatgtgaatgtagagtagagattaaaaagaatgactcagtgagttacactacccacaaggtcaatgggccggaatgaaaattcaaccactggcctatctgtgcttagtgaacaacccagaccttttttcccgtttgcaccttttttggataccaaatgaaatctgagcagctgccccttacccacccacataagtgatgtgagacaggtgacattatgtaaccgctgggtcttcctgacttcctctccagtttaagaacaggaagagcagtgcacaaaaatgttctgtcgagctgaggatatcggaacttaaccggcttccacttggacagaatacatttgttccagaacactgtgtacattctgggttttccaaatatgagaaacagatggagtcattaattcaagataaataaaaaaaacaaaacaaacagcaagccattatttgctacctgttcagatatttcacaggaagggaaaaggaacaaacaagcttttgatataccctcggtctccagtaaccaccagtgaccaaatccaaagttctcttcatgtgacctttctagcattttagttgacaagcccctcttggaaacttcataccctggattttgtaacatggcattcttacaccttccttttttctcttagattatttctcagtcctgaatatacattatcaagtcctgacctttctcatgacatccagaaccagacctgaataccacattaacagttcacctcactacgttaaaaaatcattatcatctgcctccaaatctctttctccaccccttttccccgacactgtcattgtcacagtcacacaagatggaaatcttgaagtcattttgtcctcatcctcatccttctttatgttatttggcctacattacttttctgttcccacagttgctgtcttgagtaccttgtgtctttttctgactataaccgagcctcttaaattgtctcccggtatctagtcattatcccccataatacntcacttattgtagggtagtgtcagaattattttaagatatgcgctgatcatgttgcttcttcattaaaattcattaatagctaataacaaagaggaaggcaaagttaatacatgttccttctagaagatacaggtaagcaaaatgaagaaaatatattcataaatcccaacacccaggtcatcaaatgtcatcagtttagcctgtacatattttgaaccttgggaattatgtaatacatattttgtaagctgcttatttttcttttatacatcatgagcatattcctatgcagttaactacattctacaatatatatgattttacacctatgtagtaatatcaatgtatgaattgccacaactattttaagttttatgccatccagctttttatggtgtatctttcagtacaccctgtggtttaatacaagactaagtaactgctgtctgtgttagtttatcctacaaactaagaatggcttctacagttctaaatcattggggggtgggacgtcaacaaagaatattttgtgacatgaaaattatgaaattcagatatcagtgcctatgaataaagtttcattgaaacgcagc

SEQ ID NO: 58572 - DNA, 2251 bp, Homo sapiens
ctggtcacacaggacccagtctgcggtgggggttttcccgccaccgccccgccctccctggggcccccacctcaccctctcctggcacccttcaccgtcaacctgtcgggccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctg

SEQ ID NO: 58573 - DNA, 2284 bp, Homo sapiens
ctggtcacacaggacccagtctgcggtgggggttttcccgccaccgccccgccctccctggggcccccacctcaccctctcctggcacccttcaccgtcaacctgtcgggccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctgcgtcgccagcgtcctgtttatcccctctgcatt

SEQ ID NO: 58574 - DNA, 1032 bp, Homo sapiens
ctggtcacacaggacccagtctgcggtgggggttttcccgccaccgccccgccctccctggggcccccacctcaccctctcctggcacccttcaccgtcaacctgtcgggccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggtgagcgctccacctaggccca

SEQ ID NO: 58575 - DNA, 315 bp, Homo sapiens
aggaatagttttcatgattcaacttattgaaataaacaaacagaaagctagtcgacaaaaacttcccattctgaaggtacagagagcatttctccactgctgtttgagcaattttgcatcctgccatccatctcatgatgacttcgaagtcaccattgctgattctggtatcaaaaaaaaaaaaaaaaaaaaaaggaaaaacctaaatgtgaagaaaatctatagctattgaatttgcacttatatcatgttaatggaacatattattcagcaagcctgtgtcctctgcataaacatagttctttttagttcacg

SEQ ID NO: 58576 - DNA, 303 bp, Homo sapiens
atttttttcttttttagctgtatacagttaattcagtatctaaatattctatcagtgatttataatcaaacatgtgttctaaactttataccaaagtggcctcaactaaaatcaaagacttgtggaaagttaacatggacaacaatgaaccaccttgggtcatgctgccttttttcatttgcaaaaaatgctcatgttgcagcagttcttgcattactagctttgcccactctacttgaacagcataaacacagtttctggcaactaacattttaatattggacaccttctatcattatcatt

SEQ ID NO: 58577 - DNA, 168 bp, Homo sapiens
ccatttctcttttacaattatttattcattcatgttgtctacctttttctctagattaaaaacttaattatagttattttaagtccctatctgataattttaacatctgcatcacatctgtttctggtaatgttgactactttatcttttgaccaagagtcttcattt

SEQ ID NO: 58578 - DNA, 355 bp, Homo sapiens
ataccttctttcatttaagccacccagtctatggtacttcgttatggcagccttagcaaactaatacggattcctcatcaggttcagattttgctaaataaaatgtgtttgtgagggtggtacaagcaacagtgatatatttctttaagtattttcccccagccaaattccaacaagacaataatgtctaatgcactgtctggtgaatcggaaaatctcctgaatgaaataagagcctctaatacccaaaagggaatgaagtgagtcatcaccacagcctgtgaatgaaaataactgctctgagaaaacacatgtaaaaaatgacaccatgtggattaaatagggaaacacaagt

SEQ ID NO: 58579 - DNA, 291 bp, Homo sapiens
ttaattcaccaaaaggataaagggtgagagtacaagtgtagccaagcagttgtgcttattaatagatttgttctaggattatcaaatatatcaaagaagccttccttaggtcccacatccgtggcatgcaggggattcggcagaatgggatggagtttattggggtggggtaggttactatttagacttacacttactcatgcttttcctttcacatcaggctctccatgaggaccctctgtcacccaactcttaattcatttatggtgctcttgttccctctcatggact

SEQ ID NO: 58580 - DNA, 1136 bp, Homo sapiens
ggcctactcaaagtcctatctgggaaaatgctatctggtggtaatgtgtaattttcaatttttaaaaaaaattggttctgtaatagtcttttaggcccttcccctttgtataaagatgtatttataagtaaatgaattatgaaattggttcatttccatctttttaaaaggtagtcaaaaataattgtcagatgcaatgagatattggatgagctgcataggtaagatataagcagtgtacaaagtgggataaaaatgccactttacatacttttttttttttttgagaaagagttttattcttattgcccaggatgaagtgcagtggcgcgatctcagctcactgcaacttccaccttccagtttcaagcaattcttctgccctagcctcttgagtagctgggattacaggcatgtgccaccatgcctggctaattttttttgtatttttattggagacggggtttcaccatgttggccaggctgtctggagctcctgacttcaggtgatctgccgacttcgacctcccaaaatactgggattataggcgtgagccaccacacccagtccacttttcatactttctaaaacaatatttagggatttttgtgttagccactctcctatctcatttctccaattgaagtaatgcataaatcttccattctcttttttctctcattcatggatagaatgaatgtctataatgaaaagagcttcttatcaatagccctctcagatttgttctgaattttgccaaatatttgtataactctgcaaaagactttctttccctgccttctcctttagagggaaaaacaaactgtaggtgtgacagcttacctcctagcattgttgtgaggtttggctggcacaagataaagtgctgtgtaattactctgaaatgtttgtaattaataaagaaatgaattgtaggcactttgtcagtagaaaccactgtgatttggaaacgcaatgtttcaataataaagactataaaatttaaaaaagaaaaaaattaattctctccaaattataaattaaatggtatacctaatgactttccttagaacttgaaaagcttaacccaaaatttatatgaaaaggcaagagcctggaatggttaagacaacgt

SEQ ID NO: 58581 - DNA, 919 bp, Homo sapiens
acctgagacactgctgatgcatttctggcctcgtagtttctgctgtgataaataaagccattctaatttggggtcctttgaggtaacctctagttacttttgggagcttttagtataatctcttaatcctcaggttacccaaaattcatcatcaagcctcttggtctgaggttaataatctatcagtcccttttttttttttttcctgagatggagcctcgctctgtcagccaggctggagtgcagtggcacaatctcgactcactgcaagctctgcccctgggttcacgccattctgctgcctcagcctcccaagtagccgggactacaggcacccaacaccacacccagtccacttttcatactttctaaaacaatatttagggatttttgtgttagccactctcctatctcatttctccaattgaagtaatgcataaatcttccattctcttttttctctcattcatggatagaatgaatgtctataatgaaaagagcttcttatcaatagccctctcagatttgttctgaattttgccaaatatttgtataactctgcaaaagactttctttccctgccttctcctttagagggaaaaacaaactgtaggtgtgacagcttacctcctagcattgttgtgaggtttggctggcacaagataaagtgctgtgtaattactctgaaatgtttgtaattaataaagaaatgaattgtaggcactttgtcagtagaaaccactgtgatttggaaacgcaatgtttcaataataaagactataaaatttaaaaaagaaaaaaattaattctctccaaattataaattaaatggtatacctaatgactttccttagaacttgaaaagcttaacccaaaatttatatgaaaaggcaagagcctggaatggttaagacaacgt

SEQ ID NO: 58582 - DNA, 210 bp, Homo sapiens
ctccccaaagttgaccagatagatgtatcatctttccggatgtgaattatttcggctgtgtgctatgagaactgggtatggtgggaagtaattgtttttctggctctcatcaggtcctggttcctggttgcttttctttacccgagagggccacaaaagataccactctcctgagacttccaagttccccttcagcaagaccctcattcc

SEQ ID NO: 58583 - DNA, 261 bp, Homo sapiens
aaaaatttagtgaagacgtgaatagatatttctgcaaagaaaacatacaagtggtcaataggtatataaaaggtattcaatatcactaatcatcagggaaatgcaaatcaaaaccacaatgagttatcttctcataccttttatgatggctaatattaaacaagagataacaagtgtttatgggggtgtggagaaaagagaatgttcgaacactcttggttgaaatataagttggtagaaccattatgcaaaacagtatga

SEQ ID NO: 58584 - DNA, 267 bp, Homo sapiens
gctcatgatgtattggtaatattttctgggttttcccttttgggatgctgagcacgaaagactccttagtaattattttgtagtagattgttctttttgtaattgctagtctgaaaatcacatgtaaattacatatagtatactaagctaaacaagaatattaatattgttgcttccctgtgagaagcagaagcatctaaaaaaaactctagattttataataatgctaactgttataccaccaaataaagaaacaaatcatagcct

SEQ ID NO: 58585 - DNA, 941 bp, Homo sapiens
atcccaatggccctgtccttttctttactgatggccgtgctggtgctcagctacaaatccatctgttctctgggctgtgatctgcctcagactcacagcctgggtaataggagggccttgatactcctggcacaaatgggaagaatctctcatttctcctgcctgaaggacagatatgatttcggattcccccaggaggtgtttgatggcaaccagttccagaaggctcaagccatctctgccttccatgagatgatccagcagaccttcaatctcttcagcacaaaggattcatctgctgcttgggatgagaccctcctagacaaattctacattgaacttttccagcaactgaatgacctagaagcctgtgtgacacaggaggttggggtggaagagattgccctgatgaatgaggactccatcctggctgtgaggaaatactttcaaagaatcactctttatctgatggggaagaaatacagcccttgtgcctgggaggttgtcagagcagaaatcatgagatccttctctttttcaacaaacttgcaaaaaggattaagaaggaaggattgaaaactcattcaacatggaaatgatcctcattgattaatacatcatctcacactttcatgagttcttccatttcaaagactcacttctataaccaccacaagttgaatcaaaatttcaaaatgttttcaggagtgtaaagaagcatcgtgtttacctgtgcaggcactagtcctttacagatgaccatgctgatgtctctattcatctatttatttaaatatttatttatttaactatttttaaggtttaaatcatgttttatgtaatatcatgtgtacctttacattttgcttaatgtaacaatatatgttcttcatatttagttaatatattaacttccttttcattaaatttttactatacgc

SEQ ID NO: 58586 - DNA, 599 bp, Homo sapiens
  misc_feature (484)..(484): n is a, c, g, or t
actaactacaaaggggaacaaggaaacctcttgggagataatgaaaatattctgcatcagccaggcatggtagtttatgcctataatcccatcactgtgggaggcaggaagatcacttgaggccaggagttccaaaatattctgtatcttgattgtggtggtagttacacaactgtataaatttgtcaaaattcaaagaactatacacctaaagggaagacttctactgtacgaagtatacctcataaataaccaaccaaaaaacctctgttctcattttagttttcctaccacttatattaaaaaagagaggctttggctgggcccagtggctcacacctataatcccagcactctgggaggccgaggtgggtggatcacccgaggtcaggagttcaagaccagcctggccaacatggtggaaccctgtctctactaaaaatacaaaaattagctgggtgcagtggcacgcgtctgtaatccnagctacttgagaggctgaggcaggagaatcgcttgaactcaggaggcggaaggtgcagtgggcccagattgcaccactgcactctagcctgggggacagagcaagactccatctc

SEQ ID NO: 58587 - DNA, 356 bp, Homo sapiens
gcacctggccgtttatttttaataaaatataatgccaaatgttcagaatatttggagactggtaaagttcatataagttgtaaatatttttactacctctttcaatcatttctcaagaattaaattccaagagtgatgagtttacactgtatgtgaatagcacagacgtgtctgaactctccacgctgacgaccttccagcactaataaggccttctcccctccagtgcctttggtaatgggcatctccctttccaattcagccacttacatcgtatttaagattatgaataagctttcattaccacacactctgccctttgtcacagccagggacatgaagtcgaacaaacaagt

SEQ ID NO: 58588 - DNA, 568 bp, Homo sapiens
gaaatgcaccatttaagttccagagatgatactccattgccaataaggccatgaaaaacagaatcatgtttaaaatccttctgagaaagcctgtattgtttctaagtgatacttgccagcaacgcaggaaaacaagctagtctcaggatgcctggggttgacatggggaaggaaaacaaaggcattggggcagctccctggacccaagcctcagaccttgtcgtcacttagaggaagtgcccagggacgcatgcttctggttggtatttgtgtgagctgataggctttgatgatgggcttgggtgtgtgtgtgcacgtatgcgtttaatagcaagttcaagttcagtgtaactgcctttggaacaatagtttccattctctgcagccagtacctgggtcactcccttgataatgggctcactgtacagctgtgaactgtgaattcagggacatgtatttctgcccagccttgaggttgcaagcacccagcacatccacacacctcgatgaaaggggcttctggaatgccatttgcacatctaaataaatccaccctcaaccgtaaaat

SEQ ID NO: 58589 - DNA, 336 bp, Homo sapiens
caatataatgggtcatccactttatttatagttgagttgggaacatttagggagatttaccaacataatgcaagcattaatttttggtttggaaagaacaaactgaatgaaataagagtaaaaggtcctataaaaggtatttagtttactcataaagccagattttatatgcgtatataccatatattattttatttaacaaatatttaataatttccattaagcctatgaataaatactaatcactgtggaagaagaaactcggaattagggagacaaaattgtactagcatcattttcacaattgttgctttgaatcatggtcatgtttgtaac

SEQ ID NO: 58590 - DNA, 200 bp, Homo sapiens
ataaaaacatgctctgttgatctgattttaacaactctaaaataaaatcctatgctacacatattcctaagtccctgttcacaaccggtcattctccaatcttgccttggtacttattctgctgtaactgtacttatattccagaacaagaaatagctttgctaaacaaagattagactaacatatgctattacctatag

SEQ ID NO: 58591 - DNA, 836 bp, Homo sapiens
ttttattgtttttggcatgtggatatccaattatcccactacgatttgttgaaagattctccttttgaggatttttttctgaacgattattatctaaagtgtgttgttgctttagggtcacagtatgcttgtgtgcatctgttaccatgtcactgtggtccttcgctgagtgcccttaggggactagaatctttccaataaaccacgtttgagatcgtatgagtcagcgtgcagtgtagcccacacttgagagtgtggatttatgtgcacagtcactttgctctgggtggaagtaggttatagttgacttactttctcggtgcttgttcctacagcccctcttttcatgtgttgctcaatctccctatcccttcttggtgcttgcacatctcagaccctttagccagaccctttagccaaacccttgccaataacagtatttttgttctcagttctgttccctctggttgcggagactttgaataaaaatgcacacacctattcagtgggatttagctggaaaaggtgaccttccaacctcacgtcaacttctggctcctcaaacagtaggttggcagtaaggcaggaaagttgttttcccatttctcactgagcagattgtgaatatttccatatggattttctgttgttaatgttgctccgattctttgttttaaaataaaaattctgaatgtgaaaaaaagagactctcctttcttccattgaattgtttggacacctatgttgaaaatcattggctataattgtaagagtttatttgtgaactctcgattctcttccattgatatatatacctatccttgcatcaataccac

SEQ ID NO: 58592 - DNA, 338 bp, Homo sapiens
tgtctgtatttattaaattgcctttactacttttagatgtccatacgttttcaaaagcaaagacctagtaagccatttgtgttcatttgctaagctatcttaggtacaggtccagattataaatgttacctgctaatcagagagcaaatttttaaattaatcacttgtaaatccacattaaaagaaaaagaaacttagaaaaacacataaatttcttttgtgatcccactattcaggaaaatccattgaaaaagcagatgacttatccgtgttaaatttttaaagcccctattaaactgtcatgtaagttcttatttatctaatttttaaacacatat

SEQ ID NO: 58593 - DNA, 367 bp, Homo sapiens
tgaattctttaaaaaaaaaaaaatgagggcagccctcaagtggggcctggcaagcttgtcatttgcaaataaatcaaaagaccatcattgcaggaaggagaaccaatgaatagagttgctttgtcattctttgatgggccccacactcaagcccgctattaaaaatgaatgcattcaagagcctctgcattaagaacataaacaattaagggcacttgagttgctctgctgagagctgctgcgaagataggagagctttctccggagatgcaggcccctgcaatctgcctcacgaggagctagagaatgggagcaattagtgttgctatctgtgcccaagcagccttcagcacggttttttttttcc

SEQ ID NO: 58594 - DNA, 466 bp, Homo sapiens
aattttaactgttttgtgattcagcatagctctgtaaaaagggtgcttttttcctcttaaactttaagctttatgcactgctttttttttttttcacattttatggcgtgtctgcctgtgtctggtcagattcagtaggatgggccagtggagaagggaagatgtgtgccccaaggtgaggcaggaaagggaggaagtccatctgccatgggacaggctctctggagggcccgacagtggccctacaaaagtggtcaggaagccttggtgtggagcctccactgtgaggttatgagcaatcctcataagcagcaggaacaggtgatgcgtagacgttcacatggactggccaggcatggtggctcacacctgtcatcttagcattttgggaggccgaggcaggacaattgcttgagctcaagagttcaagaccagcctgagcaatatagtgataccttatctcaaa

SEQ ID NO: 58595 - DNA, 325 bp, Homo sapiens
ccagttaattttgtaaagtttatagagatggtttcagttagacctgtgctgtcaatacactagcaattcacatgcacatttaaatttaaatctaagtttaaatttaaattaagttaatattaaataagatttgaaatgcaattctcagtcctacaagccatgcttcaagtgcttcatatccatgtgaggttagtggctgctatactggatagtgcaaaaagagaacattattgtaatcatagaaattctattggtaagtttatgggtagtacatggactagaatgtagtgagtagtgagctgtggatgcagagaaagacactgga

SEQ ID NO: 58596 - DNA, 448 bp, Homo sapiens
gccttcctggttctgacttgccatgaattgagccacagatctgggcagggaaggtgacaggcctcgagtgaggcagagcttctgagaaaggctgtggggttggctgtacctgtcccacgatgggctggtttgccatgtcaggttctggccaagggctgatgtgtttatctcatccattgggcccagaactgtggaaattgttcgctcactgatttgttgctcactcccccatcaggggtccattgccctgtctggcatctatgaggacctgtgggtgccaggagtgaagaggcagagatgagcttgtcctggtccttgggatgattattttttgaaaggtaaaatggaccatggggagcccctgccattttctgaggcctcatgaggattctttctcacacaggctcagctggaagctcagaaagccacgcaggacttccagagggcc

SEQ ID NO: 58597 - DNA, 95 bp, Homo sapiens
ggtgaggcacaaaaattaggttcagaaagctacacaaggttaagcagaaagaggtgctactcagtacaatttggtagtgacacagcctatccaag

SEQ ID NO: 58598 - DNA, 191 bp, Homo sapiens
  misc_feature (149)..(149): n is a, c, g, or t
  misc_feature (191)..(191): n is a, c, g, or t
tgtggagagtgagaggcagaactcggactcagtccagaggtagcttattgccaaagcccaagcctacaacaaccctatctgcccaccccaccttgctggagcagagagctcaaggaagcgggcagagggaactggcgccagacgctaancctgggcttaatgtgtggccaggattatctaaggaccaggcn

SEQ ID NO: 58599 - DNA, 172 bp, Homo sapiens
gcaaccctcctgtcagtggcctgtgcttgaggagccaagaatcagggactgcagaacactcagaaatgccttccaaggagtgtctcagactcctgcctctgccacctttcctgagtctagggtcctagcctggcccagctcccttgggtgtcctggtttgctctgcctgtgg

SEQ ID NO: 58600 - DNA, 783 bp, Homo sapiens
aaagaacacctaccatgcatacttctagggtagttattgagctcaaatgaaatatttgaaagttcttagcaaaaggtaactgaatattattacgatttttgttatagctgtagtaaattcctgccattctttggggttacatacagcagaatagtcttctgaatccctttagtagagcatagcactggttagaatgctggtgctgaagagaccttgctaggtcagcacattacctacattgactcattcttccacatgggccatgtggtgctgagttcaaatttgtgctagttggctattaatataatccttacaacaacactatttaagtccacccattccaagtcagtacatggccgggacctttactttgactgcagttgccaaagttgattgtataaaacaggagtcagcaaattacaacctgcctctcatctttgtaaatacagttcttttggaacacagccaagcccatttgtttgcatattgccaatggctgctttcatactataatggcagggtttacttgtgatagggttcatatatccctcaaagtgtattactgtttggccctttacataaaaagtttgccaactcattataaactaaacagcaagagataattttttggagcatgcagtctgaatatgaaaggaaagagaaggaagatgtaagaagagttccatttgtaatattgtgttaatttcttcataagtaagaggttattgaaaatattgaaatgacttcataggtcctagcactctgttgagagttttattgtga

SEQ ID NO: 58601 - DNA, 300 bp, Homo sapiens
cacaactaattggtaagccccttgagcgcaggaactggttttttaaagaatgatgtattcttcacagtgctttccctttctgttacccagggagcacatggcaatataagggctcctgggattgaatcttaagtacagagaaaacctaagaatgcttttagatagacagataagagaccagtagagaagagcagattgaaggtatgtgtgagaaacgttatgtaatgaaaagataattgatgacacacacttccagagggtgctggcgagattgattcaaaagcacacggctagggcact

SEQ ID NO: 58602 - DNA, 410 bp, Homo sapiens
agcaacagaagaaagggccacatatatgcaaatgcctggtcactatatctggccctgaagaaggaaggagtttgcagggctcaggagactggaaatttttgccaggagctaggaacgaggggttgggagacgttggtcaaagggtacaaagtcccagttatgcaggatgaataagttctgaagacctaacatacagcccagtgaccatagtgaataacactgaatgaacagtatactcgaaatttgctaacagaagagatcttaagtgttctcataacacacaaaacatagcaactgtatgaggtgatgggtatattaattagcctgactgtggttatacatttatcaaaatgtcacactgtggctgagtgcagaggctcatacctataatcccaacattttgggaagct

SEQ ID NO: 58603 - DNA, 489 bp, Homo sapiens
ttgctctacctgccactaccctgaacctttttttttttcaacccccttaacctctttaaagagcttctggcatgctcatgggtttttctttctagaactttccctgccctgaatttgttcagtatgcattgtcacttgtgaggacttcttttcacaataaatacccaagtgctttagaatgtctggatggtggccaggcacagtggctcaagcttgtaatcccagcaatttgggaagctgaggcagacggaacccttgaaatcaggaattcgtgacctgcctggccaacatggtgaaaccctgtctgtactaaaaatacaaaaattagccaggtgagtgtaatattttttaagtgagaaagacttgaagtggccgggcgcggtggctcacgcctgtaatcccagcactttgggaggccgaggtgggcggatcacgaggtcaggagatcaagaccatcctggctaacatggtgaaaccccgtctctacta

SEQ ID NO: 58604 - DNA, 301 bp, Homo sapiens
ggctctgtgtccccagccaaatctcctctccaattgcaatccctgtatgtggagggagggacctggtgggaggtgattggatcatgagggcgaatttctcccttgctattctcatgataataagttctcataagatgtgatcgtttgataactgtccggagcttccctcttctctctctctctccctctttctcctgctaccatgtaagacatggcttgcttccccttcaccttccaccatgattgtaagtttcctgaggcctcccagccatgcagaactgtgagtcaattaaacttcttt

SEQ ID NO: 58605 - DNA, 602 bp, Homo sapiens
ggggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagcgcgtcagaagcattcaagcagacggcttagtctggggctcatctaaactagttccagtgggatacggaattaagaaacttcaaat

SEQ ID NO: 58606 - DNA, 834 bp, Homo sapiens
  misc_feature (77)..(77): n is a, c, g, or t
  misc_feature (92)..(94): n is a, c, g, or t
ggggcgtcttcggtcatctccggcgcttctagggctggttcccgtcatcttcgggagccgtggaggtacgaacttangacatgcctattttnnnaatttacttccaaacgcaacgaaaggtccatggacaatttgtgggccatttaattcagggcccccaattcgtacgtggagaagtgggaatgcgtactttgacctttaaccttcggtccggcgcggtggagggcgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcgggggctgccggcagcccccgcaagacggaagaagccacagagagaaccaccagcattgccaccaccaccaccaccaccacagagtctgtggaagaggtggttcgagagg

SEQ ID NO: 58607 - DNA, 780 bp, Homo sapiens
  misc_feature (77)..(77): n is a, c, g, or t
  misc_feature (92)..(94): n is a, c, g, or t
ggggcgtcttcggtcatctccggcgcttctagggctggttcccgtcatcttcgggagccgtggaggtacgaacttangacatgcctattttnnnaatttacttccaaacgcaacgaaaggtccatggacaatttgtgggccatttaattcagggcccccaattcgtacgtggagaagtgggaatgcgtactttgacctttaaccttcggtccggcgcggtggagggcgcctccgtctctatataaggaattttccggtctcttcgggtcctttttcctctcttcagcgtggggcgcccacaatttgcgcgctctctttctgctgctccccagctctcggatacagccgacaccatgggtttcggagacctgatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcgggggctgccggcagcccccgcaagacggaagaagccacagagagaaccaccagcattgccaccaccaccaccaccaccacagagtctgtggaagaggtggttcgagagg

SEQ ID NO: 58608 - DNA, 919 bp, Homo sapiens
  misc_feature (77)..(77): n is a, c, g, or t
  misc_feature (92)..(94): n is a, c, g, or t
ggggcgtcttcggtcatctccggcgcttctagggctggttcccgtcatcttcgggagccgtggaggtacgaacttangacatgcctattttnnnaatttacttccaaacgcaacgaaaggtccatggacaatttgtgggccatttaattcagggcccccaattcgtacgtggagaagtgggaatgcgtactttgacctttaaccttcggtccggcgcggtggagggcgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagcgcgtcagaagcattcaagcagacggcttagtctggggctcatctaaactagttccagtgggatacggaattaagaaacttcaaat

SEQ ID NO: 58609 - DNA, 606 bp, Homo sapiens
  misc_feature (77)..(77): n is a, c, g, or t
  misc_feature (92)..(94): n is a, c, g, or t
ggggcgtcttcggtcatctccggcgcttctagggctggttcccgtcatcttcgggagccgtggaggtacgaacttangacatgcctattttnnnaatttacttccaaacgcaacgaaaggtccatggacaatttgtgggccatttaattcagggcccccaattcgtacgtggagaagtgggaatgcgtactttgacctttaaccttcggtccggcgcggtggagggcgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgatgtgatataccaatcgtaggcata

SEQ ID NO: 58610 - DNA, 867 bp, Homo sapiens
gtagtaatatgttcatagaaactttattcacagcagccaattactggaaattacccaaatgatctaaaaacagtataagagataaatgagttgtggcatggtcatacaacagactccagcagtaaatttgagcaaacttcagttgcatgcaacaatatggatgaatcttacaattacaatgttgagtgacagaagccagacaaaggttcatagtgtgtgattccatttacataaagctgaagaacagacaaaactaatctacagagtcagaagtcaggatggctgtaacccttgtcagggcagagggtcctagcattggaagggtacacgaggggggtttctgggatgccggcatccttctgtttcttgattgtggtgctgattttatgaatgtgttcattttgtgacaattcattgagctctgctcttatgatttatgtgcttttctatatatgtacaagacttcaacaaaaagttaagcatatatgctgaaagtgagtaattttttgtctaccactggctactaaagatggaagcttgtttagatggaaaattattcattaaatagtttgagtttagaaaaagaagattttataaggtatatttaccagagaattgtacttatttgcataaaaattgtttttcctagaagaaaagaccttttttatcccaggtgctagacttcatcttattcttactagaaaacttttttggctattttatttgtgaatttgggccataaacctatgtgaagaccagcttgtgattgcagaacacacaagagactttccctttctacactacggtcagggattttcttttacttttttatttttccctagtcttggagtggataggatgataggt

SEQ ID NO: 58611 - DNA, 1260 bp, Homo sapiens
aggccaggcggagggggcggggcttcggccggctaagccgcggccacccgcggtctgagggaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatgg

SEQ ID NO: 58612 - DNA, 1159 bp, Homo sapiens
aggccaggcggagggggcggggcttcggccggctaagccgcggccacccgcggtctgagggaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatgg

SEQ ID NO: 58613 - DNA, 348 bp, Homo sapiens
ttatttcctcagtggaaatctactcactatgatgtggtagttggcgtgttgtcagctcgcaataaccatgaacttcgaaacgtgataagaagcacctggatgagacatttgctacagcatcccacattaagtcaacggtaggttttctgagttgttgccttgcctggtttattgaaataagagttctgaaaaacctagccaggcgtggtggtgtgtgcccgtcgtcccagctaccggggaggctgaggtggaaggattgcttgagcttggaaaattgaggctgcagtgagccatgattgcaccactgcattctagcctgcatgatgggaatgagtccctgcctaattt

SEQ ID NO: 58614 - DNA, 306 bp, Homo sapiens
  misc_feature (19)..(19): n is a, c, g, or t
aaaaatattgatgtccttnaccgggtgcggtggctcacacctataatcccagcactttgggaggccgaggtaggcagatcacctgaggtcaggagttcaagacccttggattaggcaatagtttcttgagtgaaacaccaaaagcatgtacagcaaaagaaaaatatagataaatcagactttatcaaaattttaaacttttgtgcttcaaaggacactagcaagaaagtgaaaagagaactcaaagatggaagaaaatatttgcaaattttatatttgataaagagtataccagatatataaaga

SEQ ID NO: 58615 - DNA, 221 bp, Homo sapiens
ccccttcatcctggagatattcagcaatatccagaagcacttttggttgtcacatcttggggtgggagggttgcctctggcatctagcgggtagaaaccagggatgctgctatatatcctgttccaataattaagaattatctgacccaaaatgtctatagcattgagatagagatatcctgcaccaatccattacagaaccaaaactttactaattacag

SEQ ID NO: 58616 - DNA, 203 bp, Homo sapiens
gtttttaaaaactttacataaatgtctcttgttatatgtgacattctgaaattaccttgttttcattcaacttgctttagaaatttatccaggttgatatatgtaaaaataattcattcatttaattgttataaagtgtcgcattatatgattatactacatttctgcatttttcagaagattaaagaacaagtaagaatttg

SEQ ID NO: 58617 - DNA, 264 bp, Homo sapiens
gcctgtgatgtgactcttgataagtggatttttagaaagtcaccaaatgaagaaacagagagcacactggagaagagctcaagtgaagccagactgcctggtttgcactccagttctgctgtgcaccagcttgggcaagttacttcacatctttgtgttaaatattctagcacatgaatggagaagaatgtttctagttctttccatttgggaggcacagattgtttgtaaggtcatatctatggttaaaccaggcatcttttt

SEQ ID NO: 58618 - DNA, 320 bp, Homo sapiens
aagtcccaatctctgcctcctctagttcctcaggtgcttgacctggagatctactttatgaatctgtctcctggtgacaaccttcctccttgtatcaagcagctagatgcaatctagttgacttgctctgctgaccccagcactccacgtggacggcatagatttacagcagtgaccacctttcagtcactgtgtgactataggaaactcgtgcctactttttgtaaacccaccgattccaactgcctgcagaaaacctgcttgggtaactttattgggaccccaataaagactttggcaaacaggtctctctctctctg

SEQ ID NO: 58619 - DNA, 316 bp, Homo sapiens
aaacactaactccgcattcctccctcccccgagccctggcagctaccatttcaccttctgtctctgtgaatttgattactctaggtagctcatataaatggaatcatacagtgtttgtcctttcatgactggcttatttatatacctagcaaagtgtcttcaggattcctccatgttgtatcatgtgtcagaatttctttcctttttaaggttcaatatatttcattgtatgtatataccatcccctactttttttaaaactaaagggatcatgcctatgtatggtctttctacctgcccaatatgtcagaaaaag

SEQ ID NO: 58620 - DNA, 3344 bp, Homo sapiens
cgggcgcccagagacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58621 - DNA, 688 bp, Homo sapiens
cgtgatctcaactcactgcaacctccccctcccgggttcaagcgattctcctgcctcagcctcccaagtagctgggattacaggtgcacgccactacgcctggctaatttttgtgtttttagtagagacggggtttcaccatgttggccaggctggtcttgaactcctggcctcaagtgatctgcccacctcagcttcccaaagtgctgggattacaggtgtgagccactgcacctggcctccacctccttctcttcctgctttcctccaaggcccaggtcaaatgccatcttctcaatgaaaacttcccagatcttccttttaggaatagctttcttcttcccccacaccagcataactctcctggtacctttgttatattatcaacacctcctgcctggtattagaagtagctgtatgcctgtctatctccttcctagactgtgaagttcttttcagcaaaattcagcaaacagctgctgacctactacctaccatgtgtcaagcagtgtgttaggccctggtggatgaaaagatactcagtaagaaccaaatcccagtcctcaagagctctcaatctcatagaagagataagaggtgaacataaacattatcccaatgttctatagtagttgagagatgtggtaagtatctcgctgggaaatccaaagatttctgggtctgtatg

SEQ ID NO: 58622 - DNA, 3490 bp, Homo sapiens
  misc_feature (3481)..(3481): n is a, c, g, or t
cgggcgcccagagacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaaaataaaaaaaaaaaactcgagggggggcccgttacccaattggcctattgtgagggaataacattcaattggccgcggttttacacgtggggatgggaaaaacctgcgttccccaccttaatggcttgcagacatcncccttttgg

SEQ ID NO: 58623 - DNA, 4195 bp, Homo sapiens
ccgccgccgccgccgccgcgtcctctcagccttgcgctccgcccgctgcctctgccgccgcagcgcagagccgggcgcaccggccccgcagcctgcccactcttcgggccgcgtgccggctgcagccggcatggggggttgctgagagcgagcactcctttcctctggcacctcccccggctactggccactggactctggccagcgaggctcggcccctctggcccccagtctggcgcctggcacggccctctactctgctcctccagctctgagcatcgtgtcttcgccgccccccccgcccgcgcctgggatacctgggtcccccggcgacccctaggagaggggcgggggggggcatgaagccgctggagaaatttctgaagaagcagacgtcgcagctggcgggccgaacggtggcgggaggtcccggcgggggtctggggagctgcggtgggcctggagggggtgggggacccggcgggggcggcggtccagccgggggacagcggtcgttgcagcggcgtcagagcgtgtctcgcctgctgctccccgctttcctccgggagccccccgccgagccggggctggagccgcccctgaggaggaaggaggagagccggcgggggtcgcggaggagccgggcagcggggggccctgctggctgcagctggaggaggtgccggggcccgggcctctcgggggacggggggcccatgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58624 - DNA, 3576 bp, Homo sapiens
cgggcgcccagagacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaaggtgagagagttactcccaagctgtgccgcttccacccatgcttcccttctcctatgccctgcttctgacttccagctccctctcgactcagccctgagtacccacctggagaggagccccccaccacagacggagtgggttctggggaagagcggggtcctcgggtgcagtggcccctttcgaactcctctcttatcctttcctcacattggattctctccacatcccctagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58625 - DNA, 3894 bp, Homo sapiens
cgtgatctcaactcactgcaacctccccctcccgggttcaagcgattctcctgcctcagcctcccaagtagctgggattacaggtgcacgccactacgcctggctaatttttgtgtttttagtagagacggggtttcaccatgttggccaggctggtcttgaactcctggcctcaagtgatctgcccacctcagcttcccaaagtgctgggattacaggtgtgagccactgcacctggcctccacctccttctcttcctgctttcctccaaggcccaggtcaaatgccatcttctcaatgaaaacttcccagatcttccttttaggaatagctttcttcttcccccacaccagcataactctcctggtacctttgttatattatcaacacctcctgcctggtattagaagtagctgtatgcctgtctatctccttcctagactgtgaagttcttttcagcaaaattcagcaaacagctgctgacctactacctaccatgtgtcaagcagtgtgttaggccctggtggatgaaaagatactcagtaagaaccaaatcccagtcctcaagagctctcaatctcatagaagagataagaggtgaacataaacattatcccaatgttctatagtagttgagagaagaaagtgaccttcctggtgggtggggtggatcagagaagaattcatggaagaggtggcatttgattagggttacttggataattatcccatactgctcattgtcctctcttctgacccccttaaccacctgaaattgctgctggtgcatccttgacccaattctgatattcttgcttgatgttgcctgcttggtgttggttgtccatatgcctggcagggcgtgctgatgcccagctgtgtccatgccaggattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58626 - DNA, 4748 bp, Homo sapiens
ccgccgccgccgccgccgcgtcctctcagccttgcgctccgcccgctgcctctgccgccgcagcgcagagccgggcgcaccggccccgcagcctgcccactcttcgggccgcgtgccggctgcagccggcatggggggttgctgagagcgagcactcctttcctctggcacctcccccggctactggccactggactctggccagcgaggctcggcccctctggcccccagtctggcgcctggcacggccctctactctgctcctccagctctgagcatcgtgtcttcgccgccccccccgcccgcgcctgggatacctgggtcccccggcgacccctaggagaggggcgggggggggcatgaagccgctggagaaatttctgaagaagcagacgtcgcagctggcgggccgaacggtggcgggaggtcccggcgggggtctggggagctgcggtgggcctggagggggtgggggacccggcgggggcggcggtccagccgggggacagcggtcgttgcagcggcgtcagagcgtgtctcgcctgctgctccccgctttcctccgggagccccccgccgagccggggctggagccgcccctgaggaggaaggaggagagccggcgggggtcgcggaggagccgggcagcggggggccctgctggctgcagctggaggaggtgccggggcccgggcctctcgggggacggggggcccatgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgaggtggggaccgaggctggtgctatgctggggggctggagggagaaatgtgccattgggagacggtgttcgcagcacaacgtcctggttccaaggctcacttgcagcaagcccttgggcaacgcatggccgtaacctttgttcccccatctgaaaaaaatcgcaaagagagagaccccagagcacagtggctcagggcccaagtgctgtttacacagaacctgacccaggatttctatttttaaaatattcactattaaagaaataaaataaggcagagacaataatgcctagcagatggttgtcttgaggatgtcagccgtgagcgaatgcctggcacctagtaagtgctcagtagctggtgaaatattattaatgctggttgttttctttttccgcatctttgccgcctcctgtcctttctatttttctattttccaccccttccgcccccgccctcctgcctttcgctcctcatcgccttgcactgccatcttcccacccactcccctcaccccctggcgccctggccgcccctccgctgccgtgggtgcagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58627 - DNA, 4058 bp, Homo sapiens
cgtgatctcaactcactgcaacctccccctcccgggttcaagcgattctcctgcctcagcctcccaagtagctgggattacaggtgcacgccactacgcctggctaatttttgtgtttttagtagagacggggtttcaccatgttggccaggctggtcttgaactcctggcctcaagtgatctgcccacctcagcttcccaaagtgctgggattacaggtgtgagccactgcacctggcctccacctccttctcttcctgctttcctccaaggcccaggtcaaatgccatcttctcaatgaaaacttcccagatcttccttttaggaatagctttcttcttcccccacaccagcataactctcctggtacctttgttatattatcaacacctcctgcctggtattagaagtagctgtatgcctgtctatctccttcctagactgtgaagttcttttcagcaaaattcagcaaacagctgctgacctactacctaccatgtgtcaagcagtgtgttaggccctggtggatgaaaagatactcagtaagaaccaaatcccagtcctcaagagctctcaatctcatagaagagataagaggtgaacataaacattatcccaatgttctatagtagttgagagaagaaagtgaccttcctggtgggtggggtggatcagagaagaattcatggaagaggtggcatttgattagggttacttggataattatcccatactgctcattgtcctctcttctgacccccttaaccacctgaaattgctgctggtgcatccttgacccaattctgatattcttgcttgatgttgcctgcttggtgttggttgtccatatgcctggcagggcgtgctgatgcccagctgtgtccatgccaggattccagaggagaaccagccacccagcaagcaggtgaagccactcttccgccacttccgccggatagactcctgtctgcagacccgggtggccttccggggctctgatgagagtgagtgtgggcattaggaggggcagggtggtagaaccagcccctttcacaggaccttcttcagaggccagcctctggtggggaatagaggcaccctggaggagactgtgccagctgctgccactctgccctctgttgaaagccattttcctgtttccgtccagtcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58628 - DNA, 2152 bp, Homo sapiens
acgacctgaacttccagtacgccggtgatgtgccatgtgtatgcgacgtcccatgtgttcagcgccagcggagacaaaaaccagtacctggacatgaccaacgtgatgttctgcgaaaccccatggctgctcaacaccaccgacccgctgcgcaaccaggttgccgcgcaatggccacaggccaatggcagccttggccgcctgtatgcgatgggcgtagacgcctaccgcctggcaccgcgcctgggccaactcaaggcactgccggacacccgcgttgacggcctgtcgggcaacctgggcattggcgcctaccagcgtgtcgaccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58629 - DNA, 1732 bp, Homo sapiens
tcctgcggcttcttcctgagcagcgaagaagcggacaggtggtggagaagaaggctgcaatccctcccacaatcccactctgcaagaacagaagggtgagtagcattctttcctgctgaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccactctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaa

SEQ ID NO: 58630 - DNA, 1557 bp, Homo sapiens
cgtgatctcaactcactgcaacctccccctcccgggttcaagcgattctcctgcctcagcctcccaagtagctgggattacaggtgcacgccactacgcctggctaatttttgtgtttttagtagagacggggtttcaccatgttggccaggctggtcttgaactcctggcctcaagtgatctgcccacctcagcttcccaaagtgctgggattacaggtgtgagccactgcacctggcctccacctccttctcttcctgctttcctccaaggcccaggtcaaatgccatcttctcaatgaaaacttcccagatcttccttttaggaatagctttcttcttcccccacaccagcataactctcctggtacctttgttatattatcaacacctcctgcctggtattagaagtagctgtatgcctgtctatctccttcctagactgtgaagttcttttcagcaaaattcagcaaacagctgctgacctactacctaccatgtgtcaagcagtgtgttaggccctggtggatgaaaagatactcagtaagaaccaaatcccagtcctcaagagctctcaatctcatagaagagataagaggtgaacataaacattatcccaatgttctatagtagttgagagaagaaagtgaccttcctggtgggtggggtggatcagagaagaattcatggaagaggtggcatttgattagggttacttggataattatcccatactgctcattgtcctctcttctgacccccttaaccacctgaaattgctgctggtgcatccttgacccaattctgatattcttgcttgatgttgcctgcttggtgttggttgtccatatgcctggcagggcgtgctgatgcccagctgtgtccatgccaggattccagaggagaaccagccacccagcaagcaggtgaagccactcttccgccacttccgccggatagactcctgtctgcagacccgggtggccttccggggctctgatgagagtgagtgtgggcattaggaggggcagggtggtagaaccagcccctttcacaggaccttcttcagaggccagcctctggtggggaatagaggcaccctggaggagactgtgccagctgctgccactctgccctctgttgaaagccattttcctgtttccgtccagtcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggaggtgagggtcaggaagaactgggctgatgctccgagaggagaaactcacaagctcagggctctgggggaggggtagagactgaattctaggcccttgctactcaaagtatggtcccgggacaagcctcatgtgcatcgcctgggaacttgttaggatgcagcatcttgctgggtgcagtggtgcaaacctgcagtcccagctactcaggaggctgaggcagg

SEQ ID NO: 58631 - DNA, 314 bp, Homo sapiens
agcctagcctcccatctttcttctcaattcctcaggtctgcttgcgtagggatttttcttaacttaagggtcagctttgttcgggcaggaggcatggagggccctgaagggctgggccggaagcaagcctgtctagccatgcttctccatttcttggacacctaccaggggctgcttcaagaggaagagggggccggccacatcatcaaggtgggcctgggggaagagaaggtgggtaaacaggctattagctctggaagggggcccctgtgaaggagccatacttctcattctgggtacctggaaggaagaga

SEQ ID NO: 58632 - DNA, 752 bp, Homo sapiens
tccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtgg

SEQ ID NO: 58633 - DNA, 1277 bp, Homo sapiens
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagttgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctctcagaaaaaaaaagctttc

SEQ ID NO: 58634 - DNA, 999 bp, Homo sapiens
cttaaccacccatgtgtatgtttctgaattcactgtcttctatgcagctgggtccagacatatgagagggacaaaccagtgagtgtctccgagttcctcctcttgggactctccaggcagccccagcagcagcatctcctctttgtgttcttcctcagcatgtacctggccactgtcctggggaacctgctcatcatcctggccataagcatagactcccgcctgcacacccccatgtacttcttcctcagcaacatgtcctttgtggacaactgcttctccaccaccgtccccaagatgctggccaatcacatactcaggactcaaaccatctccttctctggctgtctcatgcagatgtattttatcagtgagcttgctgacatggacaatttcctcctggctgtgatggcctatgaccgctttgtcgccgtgtgccgccccttacattacacagcaaagatgacccatcagctctgtgccctgctggtcactggatcatgggtggttgccaactcgaatgctctgctgcacaccctgctgatggctcgactctcattctgtgcagacaacaccatcccccacatcttctgcgatgtgactcccctcctgaaactctcctgttcagacacacacctcagtgaagtgatgattcttactgaggctgccctagtcacgatcaccccatttctttgcctcctggcttcctatatgcacatcacctgcgttgtcctgagggtcccatccacaaagggaagatggaaagccttctccacctgtggctcccacctggctgtggttctcctcttctatggcaccatcatgtctccatatttcagaacttcatcctcccactcagctcagagagatatagcagctgctgtgaggttcacagtggtgactcccgtgatgaatcctttgatctacagcctgaggaacaaggacataaaaggggctcttgtaaaagtggttgctgtgaaatttttttctgttcaataa

SEQ ID NO: 58635 - DNA, 401 bp, Homo sapiens
atcctgggaaggggagcccattggcctaccctgatttagcacgggacatttctctgagtctctagtgttgttttaaattggcctaggtaagtggtgttcccagcccttttagccccagagcccctttcacaaattcctgagatttaaggcaggcgtggggaacgattctgttggatctaggggccaggccaaaccccatggcagtctgaggcccctccaggcgcctctggagcaggtggttcctgggggcttggcagcagagtcccccctttttcagaagtaccagcctaccacatctgggtgctctccctactcagccatagccactccagctgctttctaaatgactccattttccaaggtccttctttaataaagaaagctaattttgctgctgttca

SEQ ID NO: 58636 - DNA, 1452 bp, Homo sapiens
ctcagcaattccagtggagctgatggcccagccagcccagggcccataaccccctcccccaggagccctgagccttccagtgacccagcgggccatggagggatgggttctccctaaggtgtacagaaaagacacgaaaggcctgtttgcacgtgagcctgtgggttcatgtacgttgtggccatgcagcagtgtgagaatccatgtgacgattcttgtgtatggagcatgaatcttgtgcatggtgtggcgtgtctaggtattatgaatatgtgtttgtgtacagatgttttcatgcatgggggagttgggcctttgcacatacacatgcacctgtgtgagtccagataggtatttacatgcttgcctttgtgcctgtgtgtatgatgtctgagtgtgtgtgtgtgtgtgtgtgtgtgtgtgtgtgtgtgtgtgtccatgcacctgcctgagtgggggtcattgggtgcactcatcctgggctcgcaggctcactgtcagggccagcaggatggaagacacacaaggatctctcctgccttccccctctgcactggccgtgtcccagggaggtacctgacaacccgtcacacatgcacacacacactcacactgggccagaacgcggaccacagcccctccctgcaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtgt

SEQ ID NO: 58637 - DNA, 496 bp, Homo sapiens
aggcagcacttgttacaaagcaacttcgaacttaggtctgggattgctataatgcattcaatgtgctttccttgaatcacaactttttctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtgt

SEQ ID NO: 58638 - DNA, 569 bp, Homo sapiens
atgataggatagtaggaggtatatatatattgtcatttgtataaaatattgtgaaaagtgaaggaggacactcagtaaacatccgggactattgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagccagtgtggagctctctccacactgggagcaggtgtccacactgaagggccagctgcagcaggagcttcgaaggagctcagcaccgatcaggtttcattgtagctgaaa

SEQ ID NO: 58639 - DNA, 3727 bp, Homo sapiens
gcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggccaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtgt

SEQ ID NO: 58640 - DNA, 3148 bp, Homo sapiens
ggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctga

SEQ ID NO: 58641 - DNA, 511 bp, Homo sapiens
gtgagagggtttcagctgggatgggcaagaagacccctaagctatagcagagaagttgggcttgattctgagggctgttgggaaaggcagggatgacagtgagtgagatgtgtgggaggcccgtggcttctgcatcactgagcaagtcttctttctcttctaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggtaagcctgggtgtgcatggctggatggggaacctggagggccctggggaggttgcagggtgtcagagcaggggtctgtctttgttcccccatgtcggggctacaggacgaacttcggacccagaccagtgccctgaatcgccagctggccgagatggaggctgagagggacagcgca

SEQ ID NO: 58642 - DNA, 6493 bp, Homo sapiens
ggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggccaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtgt

SEQ ID NO: 58643 - DNA, 3352 bp, Homo sapiens
gcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtgt

SEQ ID NO: 58644 - DNA, 278 bp, Homo sapiens
gcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgg

SEQ ID NO: 58645 - DNA, 272 bp, Homo sapiens
aggaaggagatgggaggatagactttaggccagtccagaggagagatatgtggcaggacaagtctctaccctatacaagtgcttccggcaagccctcagcacatgacataggcccagagaaggatgcaaagaattctggtcataaattgttttcaaatatcaaataaatcatatgtgcacatgcacaaacatgccttcacaactgagtaaaaccagactcaccttcaaatatatcaacagttttctcaagcgccgttaaaaatcaggcatcg

SEQ ID NO: 58646 - DNA, 1146 bp, Homo sapiens
gaagaaggagctgactcagccagttctgctacacagctatttctagccatgaatgtattaggtggggcagcaaaaaaattaattttttaaaaaacacatgtgcctccatagaacctgagggtatctactgaattagaagttcataaatatagtaaatttttgtaattataacccatgtatcaagaagagagtagattacagtcagttttcaaaggaggcaagggcaaatataatacatttcagaaatgcttttcaacagtggctaaagctgcttccgtttgacccttaaaagactaagcttccattatttgaaaattttacttactgtttataaagcaaagagtagggacatacagtgtgtgtgtcagggtttcaaatgtgccctctcttctttcatctttagcttggaatcaggtcacttgactttgaatcttatatccgcccctcggtatgttgaccttaaaaaaagtcacttaccccctctgggactcagtttctcatttgtaaatagaggataaaaaatacctgccctgctggcttcatgggtttcctgtgagactcaaaatcaaataagagctttctatgatccatccctttctcttctcctcctattttatttgtcttttgcctctctatgttttttgtacttccccagatccctcccccagagttacactgggagctggtcccttggagcctattttcacagcttagttgccatctgcttctcccagccagaacttaccttgggtgcatagatagccctgcttgatatgcctaactctagttcccaggatttactgcctcagatgctgtcctccctcattcccatctccaaccccattcacctgccctggactctcagcttcccagtatgcccaggagataacattttcccctaccagccttgtccaaaccctcatggcttactcctgctgaaagtctttccgctcctggactttgtaaatgtgagagggaaagactctctcagctttgtgtaacaactgtcagggtgaattagctttttttccctgtattttgcccacttaccttttttcctgtatcttgctaatttggcatgaagatttttgttctttaaagtattttcttgagatatttagggcagagcctgttgctaaaaaaaaa

SEQ ID NO: 58647 - DNA, 389 bp, Homo sapiens
agattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatt

SEQ ID NO: 58648 - DNA, 1902 bp, Homo sapiens
ggagtgagcgcggcagtggccctggcagctggcggagcggcccagcccgtgtgcacgtggcgccggcgctgcctttcggttgccaaaattcaggctgtagacggcgagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccggcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaaacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccaggacagtgtaccaaactcaaagtgctaatgctgatgtccctatacaatgtaagcatcaatttgaaaggcttgaaatacatcagcgagagtccaggattcatccctttgctgtggtggcttttgagtgatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtatta

SEQ ID NO: 58649 - DNA, 3137 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaa

SEQ ID NO: 58650 - DNA, 5400 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaaaaaacactaaattagtttaaaatgaagcaatttatatctttatgcaaaaacatatgtctgtctttgcaaaggactgtaagcagattacaataaatcctttactttaatca

SEQ ID NO: 58651 - DNA, 2899 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaactgttggcgagagtgagagagggttgaagtcttagtggcacttcacatgcctctgtggattctctgagtgtctctctgggatgaaggtgacttccacccacaccatcttgcgtctgaagcactagttgtgtgagggcagctccattagacgagtacacaactcagttgccat

SEQ ID NO: 58652 - DNA, 2781 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgagtaagtacctattaattagccttcataaaataaactgcagagttatgcgttatga

SEQ ID NO: 58653 - DNA, 5751 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaaaaaacactaaattagtttaaaatgaagcaatttatatctttatgcaaaaacatatgtctgtctttgcaaaggactgtaagcagattacaataaatcctttactttaatca

SEQ ID NO: 58654 - DNA, 4185 bp, Homo sapiens
  misc_feature (14)..(14): n is a, c, g, or t
  misc_feature (50)..(50): n is a, c, g, or t
  misc_feature (115)..(115): n is a, c, g, or t
  misc_feature (122)..(122): n is a, c, g, or t
  misc_feature (126)..(126): n is a, c, g, or t
  misc_feature (130)..(130): n is a, c, g, or t
  misc_feature (148)..(148): n is a, c, g, or t
  misc_feature (155)..(155): n is a, c, g, or t
  misc_feature (209)..(209): n is a, c, g, or t
  misc_feature (498)..(498): n is a, c, g, or t
aggtttcaagacanccgaagaggtttcagtgtggttatttacaacagagnctgtaaaataatggtaaattagatatggagctaaaaaaggcacagctttccctttcttaaatacnctgtaancggntcantatgcatgcaggacattncactttnccaaaaaaaattaccttgtttagaccaagatagtacttaaatagtctccagccnaatagaattctttccaaaatactttcccattcatcctattaaccattaaagattttttttgtatgtgtctcatttacaaaagatccttatacattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaaaaaacactaaattagtttaaaatgaagcaatttatatctttatgcaaaaacatatgtctgtctttgcaaaggactgtaagcagattacaataaatcctttactttaatca

SEQ ID NO: 58655 - DNA, 2539 bp, Homo sapiens
  misc_feature (215)..(215): n is a, c, g, or t
  misc_feature (1713)..(1713): n is a, c, g, or t
cgcgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagngatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgangggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatgtgggtgttccttttacatattttttcctagtgtgtagtttacttgtacagctaatgctatagcattattgggaattcttcaaaaagatttttgatttaatctgtcagtgataaacagtaatagtgccttgtataaaaaccacctggagattttccacaaagcaatatttaatgagcaaaatttgaaattctgagcaaggatcaaccaaagaggtttttttgttgtttgtcacagtttgtttttcagtaagactcagaaaaataattccttgtcattgtaaatttaatttatgtgatctggaatagaagttttactaggcacacacagaatacatgatttctgccttttctgggtttctgtataaatatgtgtttgtggcaaattaaaacgttaatatcagaatcaagtctgtg

SEQ ID NO: 58656 - DNA, 388 bp, Homo sapiens
cccagcagcagtttgtcctgggagcaacagcaggcgctggtttggcttgattgtgaaaagaggggtcctgtgatgctcttatatctttctgagaacacagagtatgtgatcgctcccacacccggctgtagccactgggtttctgttttaaatatgagtacctcagtgagtcatagggagtccatttggtctgtgggctgtgaacatactttaaacaatcccaatcctgttctctcttgacaaatcactttctttacccaaatacagatactggagtacgtgtctttcctccccttaaggacagtacctcttgggcttactttagttagccccacctaggagagagcctggcacatgttaggtcttaataaacactgagcaaatgaat

SEQ ID NO: 58657 - DNA, 342 bp, Homo sapiens
tgctgctggccggccatgtttcagcttctcaagctcacctagtgggttacggctcatccaccaggtttccagtctccaaaatgttctgtttaaagaggagaatggatggttacacatcctgcttgggatccaatcactgaaccagaggggaacaccgtgcatgatgggctggtaaggcgtgggggtcagtacagcatgacacagaaggaggcgtcgagctgagatgctaacaatagccaagcacgatgccggcctgattggagaggctaaaaaaagcagctcattccaaagcctcatcagggaagaaaagggccacgaaggcaggtttgcagggctttaggg

SEQ ID NO: 58658 - DNA, 505 bp, Homo sapiens
agtctgcctgtccttcaggaaatgccagaggaaaaagattctttggctgagctgatgctctcagtgtcaatagctccagccctatgcaatctccattcttccacccccatctctatttcacaggttgctgtaaagagaagaaaattcttattgtaatctttattcaagccaagtcttgataccctggggctgtgggagaggaatggcaagccatggaagaatagaggagccagaaagatgggaatagaaagtctgtgctaagtaccaggcaggactggtcttcaaccttgatgtcttatgatactgtagttaattttgttcactaccagctatttatttgcaaacgttcgtggttcaacattctgcttaaagtatggacagttatcttcttcatcgatgtgtggccatatgtttctattcctctccttaaatcctccctccatcctgagaccactctttcttaatgttctaattttaactaaatgcatgtaaatgtatgtaaaaa

SEQ ID NO: 58659 - DNA, 2501 bp, Homo sapiens
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcagggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcacttttgaagagtgtgaggaaaacctatgtttgccgcttaagctttcagctcagcttaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacaactgttatcttcacttttataagaaataggaaatattttaatgtttcttggggaatatgttagagaattcccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttcactcatattgt

SEQ ID NO: 58660 - DNA, 581 bp, Homo sapiens
cacttataatgcttctgagcatataggaaacactatacatgccaactaatttcattaccatcattatcatcaatgtagtttcttttgagtgtaataatgtctacatacctaccttctagcctccttcctacacgccaaactccttgaaagccaaatgataaatgttatctcttcaaagaactatttgaatccatctcttaagggattaggacttatcgcactgaagaaggtaccaaatctacaaagtttagcaagaagccatgcccaggaagccaaaataaaactagaaccattggtaaaaattaaagatgggtttatggaaaatgatgcaaatgcaaagagatatgattattagctccatgggaaagaaaatataagaaaagtaaatatagccatagtgaaattatctgactctataataaacaatgtttacatgaacctaataatataaatattgatgactaacacaaaattgtttattggttttaagaagatcaaatcaatatgaagatgttcagttgatttttgaaatggtaaaatgtgtcatgtgtttttatatttccacagttgtacttttacag

SEQ ID NO: 58661 - DNA, 375 bp, Homo sapiens
gcggccgcctactactactactgctcgaattcaagcttctaacgatgtacggggacatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58662 - DNA, 1959 bp, Homo sapiens
aattcggcactaggggtcagagaggatcccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58663 - DNA, 2021 bp, Homo sapiens
ctagtgcgaggcgggggtgaatcggccgaggcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58664 - DNA, 2151 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacaccatctgttccgtttgcaggcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58665 - DNA, 1888 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacacccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58666 - DNA, 1441 bp, Homo sapiens
ccaggaaaacgtagccagatacgattcgagctcgtacccgacgcttcaacgccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58667 - DNA, 1682 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58668 - DNA, 1198 bp, Homo sapiens
ccacgcgtcgcggacgcgtgggttcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58669 - DNA, 990 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58670 - DNA, 878 bp, Homo sapiens
  misc_feature (17)..(17): n is a, c, g, or t
cattgtgttcgagaggngcgtttatggggcagggtttccaggagaatctctctgtttccatttctgataaagagggacatgaatgagaagagcatctgggcaccgactaacccccccgaatgcatgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58671 - DNA, 929 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtgtgtcgccagccaacaggactatatactaa

SEQ ID NO: 58672 - DNA, 249 bp, Homo sapiens
cggccgcgccctgcatgcgagttgggccgcgggcggggttggagcctactcggggcgactgcgatggacgccttagaaggagagagctttgcgctgtctttgtgagtagctcctccagggcgcaggcgacttggggccggaggcagcgggcgttcgccccggggcctgaccctataaaacaggtgtccttaggggccgggccgggccgggccgggcagggtgggggccgccaaggcgccgtcccagctc

SEQ ID NO: 58673 - DNA, 2132 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58674 - DNA, 2166 bp, Homo sapiens
aattcggcactaggggtcagagaggatcccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaaaaaaaaaaaaaaaaaactccggagggcacctaatggccgggggggggggaaaaagggggtcatggaaagcgggcccgatgggtccaaacgctggcccccctggaacccaaggcttttcttggtcccaaggggggggaaaaccggggcggcggccccctaaaaaggggagccgcgaataaaattcggaaaacccgggttaaccggtac

SEQ ID NO: 58675 - DNA, 2052 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcaccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 58676 - DNA, 2634 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctataaaaaaaaaaaaaaaaaaaaaaaaaaaaaaaaaaaaaaaaaaaagaaaaaaaaaaaaagaaaaaaaaaaaaaaaaaaaaaaaaaaaaaaaaacaaaaaacaacaacaaaagaaacaaataaacaaacaaaagaaaacaacacagaacaacaaaacacaaaaagaaagaaaaaacgcaaacgacaagaagataaccaccaggcctcgcagcgacgcccgaagaaatcgaaccatgacaacagactgaccaccaccaggtcgccgcgacgcggcaaccgacgataacgcaggcgcgagtagtgacacgagaggaacacgacaagaacgcagaaagggagacagcacaaggagctggacgaagggatagggaagcagaaacgaggatcagacacgaagggcaagcacaggaggaggagccaagccagactgcgagccggagagccggaaacagagagcagagccgagcatggcaaccgggactcgactcaaaacaacctgaacgaataggcaagacagcagagacaagcagagaaagaaaagacgacaaaagacagaccaccaaagacacggcgacccaatgggaaaaagacaacaaagagaggaacaagtaaggaagaagagaggaaatgaaagaccacaagaaaaagaatacgaaaagaacagaaagggcgagagaacaagcagaagtaagaaacggagaaaaacacgaagagaaagcaagaaaaaacgatagaagcgagaaaaatcataacgagagaacaggacccaggacaggtggacagacgagaaggaaacactaacacgggaacgagaaccaagaaaagagaaacgacgggaacaacaacgacgaccatgaagagagcacaagctggacgaaagaagagacaagaggacagaagtcacgggagaaagaaagagaagaagacgaaagacaaatagagcagggagaacgcgagcacacagacg

SEQ ID NO: 58677 - DNA, 1060 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcccactaagtaacctttccggagtctggtcgaccctgtgaggcctttggcaccctggggctccgagtctgggggaggtgaccgccc

SEQ ID NO: 58678 - DNA, 583 bp, Homo sapiens
acaggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttaactcaggggcgagctgctaactcaggggcgagctgctaattcagggg

SEQ ID NO: 58679 - DNA, 392 bp, Homo sapiens
gtgaactcagccaagcacagtggtggcagggcctacctgctacaaagaagacatggtttagacaaatactcatgtatatgggcaaaaaactcgaggactgtatttgtgaataactgtattattttagtttctgttctgtggaaagtgtaaagcagtccaacaaagggttttaatgtagatttttttttttgcactcatgctgttgattgctaaatatagtagtgtgatcatgacgctgaataaatgtatctttaaaaaaagataacagagtgttgccaatcctgactgcacattagaatcaccaggggtcttattggtacccaaaaccatcctgcagcaagtgaaacaccatctcaactcaaataatcctgatgtacaaccgattaagaacc

SEQ ID NO: 58680 - DNA, 272 bp, Homo sapiens
tgtgtgtgtgtgtgtgtgtgtgtgtgagaaatggggaaagactggtctagataatatttcaggtacgggacccttcccaaccctaaaatggtatgattcccagcttacaaaaagcaaactattttaatattcaccactcaatatagtgtatcaagctctcggtttatgtttaaggcttagggacagcagcaactattcgtggcaataatcaaaaactatgtaccaaaaagcatgtttaggtcatgaggatagtgaaaaagcaagaccagtct

SEQ ID NO: 58681 - DNA, 1684 bp, Homo sapiens
aagggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttatggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgcttta

SEQ ID NO: 58682 - DNA, 1302 bp, Homo sapiens
aagggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttatggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttgtccaagtttcaaattggcctgtggtcataacctgtttaaacaccgtctatatgtcccaagaaacaaatcccgcataaagggttttttaagggctttaccggggtaaaacaacttctcttcgccgaataagacattggtttctccaaacccgtaaccacctcagaacctcctcttgcaattgcggcattctcagtttctctaaacacctgtttacctacttgtgctctctagtcctcttccccgctcttttttctacgctttactatac

SEQ ID NO: 58683 - DNA, 358 bp, Homo sapiens
aagggctgaggcataaaactgccagagggtctcaaggcaggcaaagaagaaccatgaggctcatcctgcctgtgggtttgattgctaccactcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgcttta

SEQ ID NO: 58684 - DNA, 1796 bp, Homo sapiens
aagggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttatggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgctttaaaattcatctttttatgataaactatattctctgtatttctctatagcattaataatcaatattaatgccattcattcagtctgttaataagaaataatatcttcaattttc

SEQ ID NO: 58685 - DNA, 188 bp, Homo sapiens
ttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgctttaaaattc

SEQ ID NO: 58686 - DNA, 439 bp, Homo sapiens
tttactgcttgtgttttacagacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttg

SEQ ID NO: 58687 - DNA, 292 bp, Homo sapiens
gaaacttatagtcttgcctcccaaccttctgaacactccagtagaaaaatcttctcgcctacctttatcaccccacgacctactagcatttcttactctcaaaaaaaatcttttctgaaaaatcaagacagagtgcaaacaatcagcataattttattatgacaaaacttttaaattttatccccctctctgagaggtctgctaggactccttcagataagtgaaaaagaaattttttaaaatttattctcaaatccgaattccaatctgtataaaaaggcgattctccctc

SEQ ID NO: 58688 - DNA, 9030 bp, Homo sapiens
gcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacataca

SEQ ID NO: 58689 - DNA, 1819 bp, Homo sapiens
gcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgaca

SEQ ID NO: 58690 - DNA, 3899 bp, Homo sapiens
gggcagatcacctgaggtcaggagtttgagaccagcctgggcaacagggtgaaaccgcatctctactaaaaatacaaaaaaaattaaccaggtgtgatggcacacctgtaatcccagctactcaggaggctgaggcatgagaattgcttgaacccaggatgtggaggctgcagtgagctgagatgtactccagcctgggtgacagagtgagactctgtctcaaataaaaaaataaaaattaaatcaatgttttcacttctactttctctgttttctcctcctaaactccaatcagttgtgtgttggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacataca

SEQ ID NO: 58691 - DNA, 443 bp, Homo sapiens
tcagtcttggcaccaaatgagccagtttatatcatcagctattcaataaaacactaatctaggtgtcaccatgaaagtattttgtgacattgttatgtacgtgttgttacaaatgtgcatgatgcatttactacagcatacaattttgcctgggtgccagcctgaagtctgtccgacagatcatagccatgttagtcccacagtcacaggggccaatggattaaattattttatctcccttgagaactaaaaataaaatcctaagccccccacccgacttagcagacccccttttggccaacggaacccgtttcttttcttttttttcttttttgattgagatgaagtctcatgcttgtcacccaggctggactgcaatggtgcaatctcagctcactgcaacctccgcctcctgggttcaagcgattctcctgactcagcct

SEQ ID NO: 58692 - DNA, 3512 bp, Homo sapiens
  misc_feature (1646)..(1646): n is a, c, g, or t
  misc_feature (2143)..(2143): n is a, c, g, or t
  misc_feature (2784)..(2784): n is a, c, g, or t
  misc_feature (2840)..(2840): n is a, c, g, or t
ggcacgagctttggctggctagggaggggatgcaatgatataaacatttatcccctgatacctcatgttaaaatctgatgcccactgtgggacgtggggcctaatggccaccatttgggtcatggtgaccaatcttttatgaatagagagatactgccctctcttgggaatgaatgaattgttgctttattattttccaagagagctagttgttaaaaagaccctggcaacttcctactctctctgttcctctgttaccatgtgttctctgcatataccagctcacctttgtcttctgccatgagtggaagcagcctgaggccctcactaaatgcgcaaacatttccagacatcagaatcttgagccacatgaaccttgtttatataaattagtcagtctcagacatttctttatagcaacacaaaatggaaaaagataacactcgcatcacaggtatgtgtctctggcagctagccaccgttcttaagatatccaggatccactcagccaagagtcttctcatcagtactctaaagacacttatcactcaagagagtctaaggtttttaggagaaaccagggacaaagtctaaatgtttttgtgataactcagattgcccacttttctttgaccacatatcttttacaggaaaaaggattgtaacagtaaagaggtattggcatattatcagagtctcatccattcattcaaaattaggccagtttatcatcctcttgtatgaatatgtctcccagaatgaaatcactcagctttgctgacaacactcaatcttaccaggttccaaaaacaagaatggtctcagggacatacagcttcactcttttaggcatccagtataattgacctaagtgacaatatcttctcttgctcacaccacctttgaggagttaagctaatattgaatttttctcattatataaccctttgatttattcacttgccctcagccactattcctccctctgtccctttatatcagttgtttccaggtttgggagtgacattaggtttgtctgctgggctggcctagactgcaggcagcaatagtattctagcatgtcttccctcagtctagtcttgatcatagagggtaggttatataggtaaggaactagtgggggctatcaagaccaccaggctatataactctacttactgttaatcctaacttttccagatgaaatgaatacttgagaattcttacataaaggtataaaaatatagttatggtttttggcttagggataattcctgtttctggcacttttatttacatccctattcctggtactatggcataacatatgaaaaaataaatttgaggtgaagtgtagtctttattccagcatcctctcctcttcagaagaattgtatgtatcgtcataacagcatcgtcctgatccatcaggtaaaagagaggatgctacctagtggagttattcttgcagccccactcatgttgacagcgagcacattcatgaagatataaaagccagtccttcatgtttatattgcccaacaattagattggcagtttttagacaaacaatgtttcaattgaccatttcaattttctatcaaattttcccctgaggaggacatgtccctctgcattgttggccntttgaggctgtaaagtgtgttttcttgtgtaaagaagtgtgactcggcagtccaaattggtgcaatctcttcttttctggttcttgtatagcccttgaagcattgacatctacccctggttgagcatagcccaatccagagtcagtgattttcctgtcaagatccattggcagctcctttggggttgctggcatcattctggcttgccaggtattatgatcaaagccttcccactagagaatctgtcacatctccatctgctgcctctgtctgttttcttgaccaacagtgaaaaaagagattatgagaaataagataaattaccaaaattgtgaacaaaagagagattatcactaatgacccttaggaagttaaaaaacattataagtgaatactctgaaaaacctgaagccaataagttagaccacttggataaaaaggaccaattcgtgcagagatagaaattgccaaaactgacccaaattaactggaaaacntgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaaaggattacactccatgaccaatgggattcatcccaggaacatatggttggattaacatttgaaaatcagttcatggaatgcactgtattaatggaaaaaaagacataattatctcaaaagatgcaggagaaacagttgacaaaaatgttaacatcactcatgttcataagtttcaacaaaataggaatggaggagaccttcttcactctgataaagggcgtctataaaaaacccacagctaaaatcaaacttaatgaagaaagactgaagactgaatgcttttctcctaagatggggatcaatgcaaggatgtccaatcccaccacttttatttaatattatactggagattgtanccagtgcaataaggcagaaaattaaaaattaaaggcatccagataaaaaggaaaanatacaattctattcacagataacatgaccctgtctgtagaattcacaagcagataaaaactggctagcactaataaatgaatccagaagggcccataggatatcaaatcaatataaaaattaattattaacatatttctctatagaagcaatgaaaatctcaactttcctatcacagtagttaccagaagagcgaaataggaataaatttaggaagacagcagtgtttgttcactgaaaataaaaaaacattcctcagagaaattaaaggtctaaataaatggagagatgcgagttggaaagctcgataatactgttaagatggcagttctcccccagtagatctataggttcaacacaatccctatcaaaatcccagcaggattttatagaaaattgacaaaataggccgggcgcggtggctcatgccggtaatcccagcactttgggaggctgaggcgggcggatcatgagatcaggagatccagaccatcctggctaacacggtgaaaccccgtctctactaaaaatacaaaaaattagccgggcgtggtggcaggctcctcgggaggctgaggcagaaaaatggcatgaacccggtaggcagaagttgcagtgagcggagatcgtgccactgcactccagcctgggtgacagagcgagactccgtctc

SEQ ID NO: 58693 - DNA, 304 bp, Homo sapiens
ttttacttggagtgttcttcagtgttaccccatcttcactttaatatgaatacttatatctctctgatctctgctttaaaaaaaactaactttttatttggaattattttatttattttattgtttagagacagggtcttgctatgaggctggtctcaaactcctggcctcaagcaattctcccacctcagcctcccaagtatctgggattacaggtttgagtatttggaataattttagatttacaaaggttgtgaagataatacagagaattttcgtatacacttgcccatctcccctaatg

SEQ ID NO: 58694 - DNA, 744 bp, Homo sapiens
  misc_feature (739)..(740): n is a, c, g, or t
  misc_feature (742)..(743): n is a, c, g, or t
ctcctcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgaggtaggttcctttatatataaaaatataaataagtaaataaatatatatatttaaagttagctgtatcctttatataaatataaattcatgaatatataaaaaannanna

SEQ ID NO: 58695 - DNA, 1842 bp, Homo sapiens
ctcctcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgacaacatcctctaactcttcaagtatttattcaatgccagtatcctagaccttctattttttgcactcaagaaggctctagactcccatgatagttcatcctgaaaatattctcttatgcccacaatcttctgccctgacaacattctgtgtacctctgtgactcaccacagctaacattggatcctcagaatatttcattctcacactgttatgggtgtctcagaagtcccaacccaacctacatcccacattcttccaataccccacctctgccaacattccctctctgaatcaatggcaccctagtctctagagttatagggttcagtataccaaagggtcttcttgcctgaactttattgtctaccaaatattccgtcttgtatcccctccatgaacatccttggtcagtgtcccttgctgttacatctttgtgcatgaccctaaaatgtagtgcaaatccttgctttggacaagttataaaactcacagtctctgtgctttctcatctgtaaaatgggttcataattttttttaattgtaacattattacaagaataaatgtcaagcatttatcacta

SEQ ID NO: 58696 - DNA, 1469 bp, Homo sapiens
  misc_feature (1435)..(1435): n is a, c, g, or t
ctcctcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgacaacatcctctaactcttcaagtatttattcaatgccagtatcctagaccttctattttttgcactcaagaaggctctagactcccatgatagttcatcctgaaaatattctcttatgcccacaatcttctgccctgacaacattctgtgtacctctgtgactcaccacagccantttaggtacagccatttagggggatcctctaggt

SEQ ID NO: 58697 - DNA, 1346 bp, Homo sapiens
  misc_feature (1322)..(1322): n is a, c, g, or t
ctcctcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgacaacatcctctaactcttcaagtatttattcaatgccagtatcctagaccttctattttttngtcccttccctccttgtccgggga

SEQ ID NO: 58698 - DNA, 2296 bp, Homo sapiens
ctacctaaatggatgaatggatagatggatgagtagacggatggacaaatcaataggatgaatgggggatggatgattggatagattgatggatagatattgcctaggtggatgtgtaggtcagtctcacttctacctcctgaaatccatcttctggtagaatgatataaaaaatgcatgtggagagaaagtcaggctcctgcttacctatcagcaacatcctcattttgtgaactcttctgttaacccccagtggaggatttggtacttcctgagaaaataatgtcacccctttgccctaattcatctccacttggtcaagaatagcaactgccataggtcggcaaattcatcttcagttcctggtcacccagggcaataatccgacccttaccccaaacccagaaaccacaaccccagggctcctctgccccctggatcccagttttctaacaatctctcttctttaccaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgacaacatcctctaactcttcaagtatttattcaatgccagtatcctagaccttctattttttgcactcaagaaggctctagactcccatgatagttcatcctgaaaatattctcttatgcccacaatcttctgccctgacaacattctgtgtacctctgtgactcaccacagctaacattggatcctcagaatatttcattctcacactgttatgggtgtctcagaagtcccaacccaacctacatcccacattcttccaataccccacctctgccaacattccctctctgaatcaatggcaccctagtctctagagttatagggttcagtataccaaagggtcttcttgcctgaactttattgtctaccaaatattccgtcttgtatcccctccatgaacatccttggtcagtgtcccttgctgttacatctttgtgcatgaccctaaaatgtagtgcaaatccttgctttggacaagttataaaactcacagtctctgtgctttctcatctgtaaaatgggttcataattttttttaattgtaacattattacaagaataaatgtcaagcatttatcacta

SEQ ID NO: 58699 - DNA, 467 bp, Homo sapiens
  misc_feature (139)..(139): n is a, c, g, or t
  misc_feature (345)..(345): n is a, c, g, or t
  misc_feature (466)..(467): n is a, c, g, or t
cggcttggcttgcccttcctgtcccattgccctggcactggcgagctcctcctggacatactccagcagtgccttctccagctgccgccaggtcacactcccttgccctgccccttccctgtctgttgggctgtacttngtgcctgtgcttgagctaggatttgggttcttttcgtaaacacatcccagtcctgttgatgtcttaagtatctctaagaaggataaatgaggagtgatgggcctggggacagggttgaaaagggtcaaggcctgggtggcgcttccctggagaaaagagggccccacagaggcgggccatgcctggctgctgggacagggcaggancagaggtgggggctgcagagcccagcagactggggccacacctgctgtcccgatcctgctcaggacagatgccaccctgttctcatgaccaccagtgccctcctgagagccccagccacann

SEQ ID NO: 58700 - DNA, 426 bp, Homo sapiens
gcgtaaccctgagcatatcatctacctctctttgagtttgcttgtcaataaaatgaagagactttgaaatctgagacttcctggataagtactaaatacagattatgtcactgatgtctgcctctatttatttctcccttttaccctaatctctataagtctacctcagtcatcctgatcctattctacttctctgatgttgttgtcagataggtgtgatcatcctcatcagatcttttctgtattcttagagacagataactttatcaaagaccacagatttattagtatagcatgttaaagtcttctaaagagtctcattgatgctcttttcatctcagtacaatttttaaaactgctgaatgcaaggtactgagctgttggaagtgactgacagatgaatgtaacagattcatagagaaggaa

SEQ ID NO: 58701 - DNA, 314 bp, Homo sapiens
ggctggagttcaacaaggctcagtgaacagcacaggatggggaagttcaaagtcagggcgactcttctggtcttaacttcctagattttcctagatctgggtgcctctgtgtatatattaaccttcatgcatttttgcccccagcaattgtgtacagtcagctccaaaggcacagcttgtgtgctaacgtgcaaagcgaagtcaaaaccctgtgcttggcgctcccttctaactttctggcttgtccaagtctaaatattgacatcgctcctcagttgagatgtttgatactgctggggatggaaacggtgcag

SEQ ID NO: 58702 - DNA, 176 bp, Homo sapiens
  misc_feature (5)..(6): n is a, c, g, or t
  misc_feature (8)..(8): n is a, c, g, or t
  misc_feature (41)..(41): n is a, c, g, or t
  misc_feature (166)..(167): n is a, c, g, or t
  misc_feature (173)..(173): n is a, c, g, or t
atatnntnggaaatctgttcattgttgatagggctgacggnctataaggaattatcactccctaaaaggaaagaaacttgcagagcaattcagcatccaaggaaagactgacagctttgaaagagacctgataatgatgcaagtaggaacttgcatgtgcttgaannaagcantgt

SEQ ID NO: 58703 - DNA, 1909 bp, Homo sapiens
cgagacccccggcccggcactcgctctcctcctgtcacgaaagggtcgcggcctgtagccctgtgggcagccgtgccgcgatgaaccccagcgcccccagctaccacatggcctcgctgtatgtgggggacctgcaccccgacgtgactgaattgatgttccaagagaagtttagctcgacaggtccaccctcaccatccgggtctttagggactggctcacccacctcttcgtgggctacgtgtccgtgaacttcctgcagccggcagacgcggagcgtgctctggccaccatgaactttgatgttataaagggcaagccagtataagtcctgtggtctcagcgcgatctatcgctgcgcaaaagtggagtgggcaacgtattcgttaaaaaccaggacaaatccgttgagaaagcactgtgtgatgcattttctgcttttggtaacttcctttcgtgtaaggtagtttgtgatgaaaatggttctaagggctgtggatctgtacactttgagacacaggaagcagctgaaggagctattgaaaaaatggatgggatgctcctgaatggtctcaatgtatttgttggacggtttaggtctcctaaagaacaagaagcagaacttggagctagggcaaaagagtccaaagttggacctgcctcaagtgtaaaagtaataactgatgaaggtggaaaatccaaaggatttggatttgtaagctttgaaaggcatgaagatccacagacagctatggatgtgaatggaaaggagttcagtggaaatcaaacttacatttgtctagctccgaaaaaagtggaagagcagacagaacttaagtgcaaatttgaacagatgaagcaagatagaatcaccagataccagggtgctaacgtttgtgtgaaaaatcttgatgagagtattgatgatgaacgtctccagaaagaattttctccatttggtataatcaatagtgcaaatgttatgatggagggtggttgcagcaaaaggtttggctttgtatgtttctcctccccagaagaagtagctaaagcagttacagcaatgaacggtaaaattgtggccagcaagccattgcatgtagctttagctcagtgcaaagaacagcgcctggctcacttcactaaccaatacatgcagaagatggcaagtgtacgagctgtgccccaccctgtaatcaacccctaccagccagcaccttctacatgttacttcgtagcagctatcccacagacccagaaccgtgctgcatactatcctcctggccaaattgctcaactaagaccaagtcctccctgggctgttcagagtgtcagaccttatccattccaaatatgacctgtgctatccgctcagctgctcgtaaccaccactctgagaccagcttcttcacaggttccaccagtcatgtccacacagtatgttgctaactcatcaatacagacaattagtccatgtcctgtagctgctgctgctggctccactcctgcggtctacatcattccacagtacaaatatgcttcaggaattctcattcctcagcagcatcttaaagcacatccacaggttaccaggaagcagcttgctgttcatgtccaaggtcaaaaacttttgactgcttccatgttagcatctgcccctcttcagcagcagaagcagatattgggtgaaagactctttcctcttattcaagccacgcaccctactcttgctggtaaaatcactggcatgttattggagcttgataatttaaaacttcttcatatgcttgtgtctccggagtctctgaagctgtagttgtactacaagcctaccatgtgaaagaggctccagaaagcaattaacagtgctactgttgtaccaactgcttaaaattgatcagggaccacc

SEQ ID NO: 58704 - DNA, 272 bp, Homo sapiens
caatactcacggttcagtcgatcatgtcagatgtttggaggttgtcattttttcctatttgcaatttgtctctactatgccctgggcaacagaaaaatttctgtaccgaaatagtctttacaaatatttgtttaggttcccagatctgacttttatgtttatcttcattctctttgttcttaactttgacctgtgattggaatacattttctaatgtaatgctatctttgtaaataacctttataaataaacattatcttattaccagctca

SEQ ID NO: 58705 - DNA, 291 bp, Homo sapiens
tgatacattatgtgatcctggatgttagaagctttgcctaatgactaggatatgagttaacatggttaccttttttaaaagtctattatcaggtaacaatattaaaaattaaaataactcccatgctaatctgattcccacagttgagatgataaaacagtcacatagtatgctaaacacatgttttccagcaagtaagcagcacagaatgagagaaaaattggagggaaattttagggaacaggctggtgcatcagaaaaaaaatggaagtaaaaatttaaaggaagata

SEQ ID NO: 58706 - DNA, 112 bp, Homo sapiens
ctgtgatcaacgtctccccttttcctatccacctcgctcctccgggctctgataaccaccattttactctctactcctatgagttgaatatattttatagtcataaaatatt

SEQ ID NO: 58707 - DNA, 2447 bp, Homo sapiens
aagtgccttgaattccttggtaattatttccttttaagcgtgtaactcttattattgctaaactgctttttaagttaatggtagttgttgtccaaaggaagtctgatctgtgtttttgaaacctcaatgatcgtctgtttctaattaaggaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58708 - DNA, 440 bp, Homo sapiens
agagtttattcaaactggataattgattgtaattgcttagaaatttaccacaaaatcgcctctgttttctttgggattgtctcctaacttttcacttcttttgagggtctgcacacgctgttctcagcagctactggtcccagcatctggggaagaaagaaatgcatggtaggacagctctttaccaatttcttttttatttgcctaattcgaagctagtgttccttctcatatgtactatccccttgaaaatgtaatacaatgtcatgtatcacccatgtgaaaatgaaaggttttaaaattccttcacccttaaagatcctccaccccaaacagccttcacctctgcctcccccaacatacagagactgtacagacacagatacagtaactgcccaataagtgtttgttgaataaaatagctgtataactttggccca

SEQ ID NO: 58709 - DNA, 2584 bp, Homo sapiens
tacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58710 - DNA, 2652 bp, Homo sapiens
tacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccaaaagaaaacaaaaataacgaaaaaaacattgtgtgggagggaagggagcaggagaagagttataaaag

SEQ ID NO: 58711 - DNA, 2647 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58712 - DNA, 2589 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacataatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58713 - DNA, 1357 bp, Homo sapiens
aatcccagcactttgggaggccgaggcgggtggatcacaaggtcaggagatcgagaccatcctggctaacatggtgaaactccatctctactaaaaatacaaaaaattagccgggcgcagtggcgggcgcctgtagtcccactacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58714 - DNA, 1504 bp, Homo sapiens
tacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaaagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58715 - DNA, 2593 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatactgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58716 - DNA, 2344 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataacctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58717 - DNA, 1585 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcacca

SEQ ID NO: 58718 - DNA, 1291 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatggtaggacagctctttaccaatttcttttttatttgcctaattcgaagctagtgttccttctcatatgtactatccccttgaaaatgtaatacaatgtcatgtatcacccatgtgaaaatgaaaggttttaaaattccttcacccttaaagatcctccaccccaaacagccttcacctctgcctcccccaacatacagagactgtacagacacagatacagtaactgcccaataagtgtttgttgaataaaatagctgtataactttggccca

SEQ ID NO: 58719 - DNA, 1502 bp, Homo sapiens
tacagtgagccgagatcggtgccactgcactcccgcctgggcaacagagcaagactccatctcaaaaaatgaaaaaagaagttaggggattatatatctttaaatgtagtatctttgaataattgcttgactttgtatctgggaactgttctttgcgtctggacaccaagtaaaacattaactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggacggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacaggtactttttacttgagcccaggggagggttaaacaatggaagaggaggatcacaaatagttatttaagtgcacttcctgtgacctttcaggtggcttgagttttgagctgccttgttcctctatctttccccatccctgccatcccttcactgaagtcttccatgaaaaacataaaatagagcaggtggataacagggttaaacctgagtgtcagacagcctgggtttacattcctagcttcctagcttttgaccttgggcaagtgacttgacttttaaaagtctcagttccctcctctataaattgtatataatacctcatagggctataaaagcacaatgcatgttaagggcttaatacagtgcctggcacctagtaagtgcccaataactactagctattatattgtattattatatctttttgagacatagtctcacttcatcacccaggcagaggttgtagtgagccgagattgtgccactgcactccagcctgggcgacagagcgagactccgtctcaaaaaaaaaaaaaaaaaaaagaa

SEQ ID NO: 58720 - DNA, 807 bp, Homo sapiens
tacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataagtaatgtgattttctttaatgaatctaacacttagcaaatggcttttttttttttaagttctcacacacactttttctgatggtccaaagtgactggtataaagactctgcagagtttacttcatgctattcataatgcagaaacaaaaccagcgaccttcaatagcactttggcctttctgagtatgtgcccagcatcattggaaagctgcgatcagaatgctattttattttatttttattttattttactttctggtctacaaagaatttgacaaccattttattttattttattattttttgagacagagtctcactg

SEQ ID NO: 58721 - DNA, 430 bp, Homo sapiens
gtcccagctactcaggaggctgacgcaagagaatggcgtgaacctgggaggcggagcttgcagtgtgccgagatagcaccactgtagtccagcctgggcgaaaagagcgagactccgtcaaaaaaaaaaaaaaaaaaagaaaaggaaagaaaagaaaatggtgttaagaaaataacattaagtggaactggatcaccctaaaagtcttcatctctgtcaccctcactcgaagcaggttgaaaaggaaggttgaggttggtcttgctgtatattaggatggcagaggcagaagaaaatccatgcaaaagtggacctgcagagttcttacctgtgtgtttaaaggtcaactgtacatttacaagttaaacagtactctgaatcccactgttaatgaagtaatttttcagggctctatctgctcgattatatc

SEQ ID NO: 58722 - DNA, 1784 bp, Homo sapiens
  misc_feature (78)..(78): n is a, c, g, or t
gcgcggcgcgccagcaacactgcacgcaggtggcaccggcggctcatgaaggagctgcaggacatcgcgcgccttagnaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgcatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgttccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctgacagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgaaaaaaaaaat

SEQ ID NO: 58723 - DNA, 296 bp, Homo sapiens
ttatttatctctaatcacaggaaatgaggacatttctcatctacaaattgcacatcccatcaggaaattgggccaaagatctctaagccttcagaagcggtcatccagtaacccacttggcaaagtttcaaaggtctgggaaagtagatgcgaggtcaagcagtgcgggaggggagccaactctgcaaacgctggccacggccagctggccaccagcagcttacccgaggaggggttgtccaagctacatactaaccccggttccctctccccaaacattgtcctctgccatctgt

SEQ ID NO: 58724 - DNA, 458 bp, Homo sapiens
gtgagtgctcagttgcgcagctgggtgtgggactgtgtgacggcaagaagcatccaagggtggacgtggccagggatgggaggagccatcggagaggtggtaaggacagcgaccgagttccccgagagaggcgagtcttagtaattcgggaattcagcccccacgactgtggtgagtgaggaggaagaatgcggaattgagagatggaaaatgaggcaggcactggccccagccctggaaagccgtcccttctcctgttctgaaagccgacttctcccacctggacgtgcaccccatctccccgggaggccccggagcctggctgcagtccgtctgtctgcctggctcgccgccatggctttgctcacccctctcatctttgccatgttatctctacacttaggatttgtggtttgtcttgtacactaataaacggcaactctattaggacatgaaca

SEQ ID NO: 58725 - DNA, 460 bp, Homo sapiens
ggggagggtggcgagcccagcgaggacgtggattccccacggcccttcccacataccccgttctttcatttggctgtttctgagttgtgtgctttataatcaactgacaatggtcctatgtcccttcctcttaaatttgggcagaatttgtgacttctttgtccaacaaaatatcgcagaagtgatgctgtaccagactgaaaaagagtggcagtttctagctgtggtatcttggatccaaagaatcaatgaccccatacaacagacccagtagagttcccaggaaacagccagcaccagccatgttggtaagatatcttgaaaatagatacttcagcccacttgagccaccacagctcacaccacctggagcacagtcaagccttttctgctgagccctgcccaaactgcagatttgtgaaccaaataaataattgcaattgttttaagccaaaaactt

SEQ ID NO: 58726 - DNA, 669 bp, Homo sapiens
ggggagggtggcgagcccagcgaggacgtggattccccacggcccttcccacataccccgttctttcatttggctgtttctgagttgtgtgctttataatcaactgacaatgcttggagcagaagagaggatggctgtggcaggcttggtgcatggtgttaaagctggctgtggagcatcctttttcagtctgcagtgtagggcatgagaaaacgcagctgacaacatgaagccatcacagtgtactcaggctccaggactgataacagcgtgtctagatggagtgagaaaaaaccaaccaataaaggcaggggcttatgggtcctatgtcccttcctcttaaatttgggcagaatttgtgacttctttgtccaacaaaatatcgcagaagtgatgctgtaccagactgaaaaagagtggcagtttctagctgtggtatcttggatccaaagaatcaatgaccccatacaacagacccagtagagttcccaggaaacagccagcaccagccatgttggtaagatatcttgaaaatagatacttcagcccacttgagccaccacagctcacaccacctggagcacagtcaagccttttctgctgagccctgcccaaactgcagatttgtgaaccaaataaataattgcaattgttttaagccaaaaactt

SEQ ID NO: 58727 - DNA, 751 bp, Homo sapiens
acggtgatgacagcatcacctgtgggttcagaatcagagacctccagcttctgtccccattttggggtaattggatggctgtattcatagagcagccggcccctgtttgctagctgaatgtcgtaacctgaatggctgtgatactggacatgcaaaaatcacatgtggctatgaccttcctgcaaaatgtgagtacaactgaatactggtggagtgcaatgtcatcatctcggctcactgcaacctctgcctcctgggttcaagcaattctcctgcctcagcctccctagtagctaggattataggtgcctgccaccacaccctgctaatttttgtatttttagtagagacgggatttcaccatgttggccaagctggtcttgagctcctgaccttacgtgatctgcccgccttggtctcccaaagtgctgagattacaggtgtgagcaagcacgcccagcccatgattctactttctgttgtatgagtctgattactttagataccatttatgaggggaattatacaatagttaccttatgtgactggcttatttctcttagcataatgtcttcaaggtttagccatattatagagtgtgataggaattcttcttttattaaggcgtgaataatatatctctatgtatgtatataccacatatttgtttatccatgtaatcttttgatgaaccattgggttactttcaacccttggtctgtgaatatggctgtaagtgaacatggatgtg

SEQ ID NO: 58728 - DNA, 495 bp, Homo sapiens
aagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatgtgagtacaactgaatactgtttcaaaaccagatgagacatcttaacttgttttactccagtgtataactggaaaaggaaatggcagtggtggtatttaattaaatgtgcttgagttcag

SEQ ID NO: 58729 - DNA, 723 bp, Homo sapiens
aagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatgtcctatgtcccttcctcttaaatttgggcagaatttgtgacttctttgtccaacaaaatatcgcagaagtgatgctgtaccagactgaaaaagagtggcagtttctagctgtggtatcttggatccaaagaatcaatgaccccatacaacagacccagtagagttcccaggaaacagccagcaccagccatgttggtaagatatcttgaaaatagatacttcagcccacttgagccaccacagctcacaccacctggagcacagtcaagccttttctgctgagccctgcccaaactgcagatttgtgaaccaaataaataattgcaattgttttaagccaaaaactt

SEQ ID NO: 58730 - DNA, 1003 bp, Homo sapiens
aagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatcaaatttggatgcaagaaagctattgaaactgaatcttctcctacacctgaagagatctattacttcaatcactccaccgaaaaatctaccaaagattaaacacgctgttgtcagtcctggagcctgagtacactgagatggcttcatgttgtcagctgcgttttctcatgccctacactgcagactgaaaaaggatgctccacagccagctttaacaccatgcaccaagcctgccacaaccatcctctattctgctccaagctgctgagagacaggaaatggaggttctgagttttgaggcttgcaaggtttgtctgcactgcattcagcttgccagaccccaagaaagctggcatgctgcttcatatccaaaaagaaaaggagagtgccaatcagaattatacaccttttgaaaacttcaattaagttcaaagccttcctttgcctgaagaaattttaccagtttacatgactgaccaaacagaaagagctacgaattgccctttgtggaacctcctgggcgtaggacacgcacaccaattaaataaaattattttaaaccaacattcctatttgtgaaaacgttttgacactcaactacccgcattgtgagaacacttaactcaa

SEQ ID NO: 58731 - DNA, 763 bp, Homo sapiens
cagcctcctctggatcttttctggttccttcgctcctagaactgtgtctgatggcttatgaaggcaaatgacaaatgtttgccatatgcacatgtatgtgcatgaatgaatacatccaggttctgacttcctcggggcaacctctactttctcaatgcccctcttaagatgggggtgggggagggtcctcctagaactgaacatgatattccaggtgtgatctaatacatttaaatgtccaaaagctctttcttccctaaacgttcctttttaaaagctactgttctcaattaatgggtgtctcatcttcttaagtatattaataagaggtattttgatgtttccctccattctgtggattacctcttgattctctggattctttgtgattccgttttgttttaaggatgttctcaggtgtctggtgatccttgcttataagtccaaattaatgatgaggcactaaaatgctgattggaagctctctgtgcaggccttcctcacacccatgtcttcagatacccaaggcctttaatacccaagtccttccaggattctgcacatctcattagcttcatattccctctatttgaaaagttcatatggacccagctctgtcatcatcacatgttctatatccccaaaccttgtgacatctgcaaagaagtacagaagacctcaagagaagataagctagaatttatttatttttataccttttattcagtttttattaaagctttcctacctttccagattgaca

SEQ ID NO: 58732 - DNA, 499 bp, Homo sapiens
  misc_feature (20)..(20): n is a, c, g, or t
  misc_feature (383)..(383): n is a, c, g, or t
  misc_feature (412)..(412): n is a, c, g, or t
  misc_feature (423)..(423): n is a, c, g, or t
  misc_feature (446)..(446): n is a, c, g, or t
  misc_feature (475)..(475): n is a, c, g, or t
  misc_feature (490)..(490): n is a, c, g, or t
atggcggcgcctggtggcangccggctgtgcagttgtcggagatggcggggcttcagcacctcggccgtcctgggccgccggacacccccgctggcccgatgccaacagtgacatcgacttgagcaacctggagcggctggagaagtaccggagcttcgaccgctaccggcgccgagcagagcaggaggccaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcttccgcacagccagtnttcccgttggatgccgtgcgggccgagtnggagaggactnttggcccttaccacaagcagctnttgctgagtatttacggctttaacgagantttttccacggttgncaatttttt

SEQ ID NO: 58733 - DNA, 201 bp, Homo sapiens
cgcccagctaatttttgtatttttagtagagacggggtttcatcattttagtcaggctggtctcagactgctgacctcatgatccacacgccttggcctcccaaagtactgggattacaggcatgaaccaccacgcccatctgatttcccgttttctgcagggtaaagcctcagggccggcccattgctttcaggactttt

SEQ ID NO: 58734 - DNA, 1473 bp, Homo sapiens
gtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctctactctgtgca

SEQ ID NO: 58735 - DNA, 1465 bp, Homo sapiens
gtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggaaagaccaagtaccgggaccgagctcgat

SEQ ID NO: 58736 - DNA, 302 bp, Homo sapiens
aaagagaaagattgttcttcaagggcctctaaggacaaaagtgaatccattaacactctaggaagcagtgtgactactggaagaaagacattcaagaggtaaaatggattttagaaggtcacaggagccaattgtcagtgtttgtactcttcatcaaaattatttttaatgagctccctgacaactgcgcatcctgacagcacgggtgaagtggctcatctggggtcatgcccgtgcctgacactgccctaattagctgacactgctctgctttgctgaagcacagggaggtctctcgagaa

SEQ ID NO: 58737 - DNA, 151 bp, Homo sapiens
taacagagtatttgtccctagtcctgtatttcccttaattcctccctccagtcccctagctcccaactgtatttaactgcgctggggctgcgtagggttgctctgtcctggggggtggccagggactcatccagtgcttgtaaataaataa

SEQ ID NO: 58738 - DNA, 354 bp, Homo sapiens
tggatgagcttatattgggtctagcaaataaacaggctacaactgttaactgtcatagtaattagttaaatgctctggtcctttctgcagccaggaatttagatagcacttactaaatgggaggggaaaggaaattcctaaatttattttcatatcaaagttttaacttcttacagcctaacagaatgatgttctttaaaatatatatgttttaaagaaactacattatattctgagaaaaatttccttttaaggtgtgcagtacaggtttggcaacagattttggtgaagaatagaactggaataattaaaagtatgacttatttcaactgtgcacagagacccagaggataa

SEQ ID NO: 58739 - DNA, 163 bp, Homo sapiens
aggaccccagaacatgtcactctgtgtcctcaggtctctggatcccacccaatgtggctgaaatactgccttgccaatccccttctcagacttgccctcttctcttcctgcagccacctctctggacacacacacacacacacacacacacaggtgcacacac

SEQ ID NO: 58740 - DNA, 249 bp, Homo sapiens
gttcctgttgtctaaccccaccatcctcccaatctagacatgaaggccacataatccatgaagccctccaggactaccacatccagagaactctgcttgaatccctgtggcacttgctgcctgtgccatcttctcagcccttggtatcaactcctgctggagactaatcattagcttttagtggatatgtgtggaaagtccatctccccatcaaactgaggacagctcagggtagagatggtgccttta

SEQ ID NO: 58741 - DNA, 2198 bp, Homo sapiens
gagacatgtactgctaaagcaaggactttgatccttttttccctttgcatttttaccatggttggaattgtaacacagacacaaccttatgtcctgcttccaaaacataaataatggttgtaaagcgtcccacacgttgacccaaagtctcctttgaaacaggaaattgagacacgccggttgtgaaacctactgaagtgagcggcggcgccagggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 58742 - DNA, 2252 bp, Homo sapiens
gttttctacccaagaatgctacttcaggagatcagtcaaaaggttagggtgatggtgacggtggaaatatagaaaaaggaatttattcaagaggtattcaaaaagaagtgaaatagagatgagttggagatagattggataaaaagagtgagggagagggaggtgtcaggctgcagcccaggttctgagttgccaaagaggagtcttttcctccaggaaattgagacacgccggttgtgaaacctactgaagtgagcggcggcgccagggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 58743 - DNA, 1106 bp, Homo sapiens
gggctccaaacgggcttttccattccagggttctcatccctttgagcattcaaagaagaggaaggcccaggagggctggataaggggtgagggtatttattcatttcacagacatcaactgagcacctcttgggttctatgaattcaattaatgaacaactgggggtgaaaggtgtcaggcagttagttaggatccctgcttggtagggggatgttaattaatgcaatgcttgaaatagggggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 58744 - DNA, 2203 bp, Homo sapiens
  misc_feature (1534)..(1534): n is a, c, g, or t
  misc_feature (1543)..(1543): n is a, c, g, or t
  misc_feature (1550)..(1550): n is a, c, g, or t
  misc_feature (1563)..(1563): n is a, c, g, or t
  misc_feature (1568)..(1568): n is a, c, g, or t
  misc_feature (1584)..(1584): n is a, c, g, or t
  misc_feature (1595)..(1595): n is a, c, g, or t
  misc_feature (1602)..(1603): n is a, c, g, or t
  misc_feature (1630)..(1631): n is a, c, g, or t
  misc_feature (1643)..(1643): n is a, c, g, or t
  misc_feature (1652)..(1652): n is a, c, g, or t
  misc_feature (1674)..(1674): n is a, c, g, or t
  misc_feature (1682)..(1682): n is a, c, g, or t
  misc_feature (1689)..(1690): n is a, c, g, or t
  misc_feature (1696)..(1696): n is a, c, g, or t
  misc_feature (1698)..(1698): n is a, c, g, or t
  misc_feature (1705)..(1705): n is a, c, g, or t
  misc_feature (1709)..(1709): n is a, c, g, or t
  misc_feature (1712)..(1712): n is a, c, g, or t
  misc_feature (1734)..(1734): n is a, c, g, or t
  misc_feature (1737)..(1737): n is a, c, g, or t
gagacatgtactgctaaagcaaggactttgatccttttttccctttgcatttttaccatggttggaattgtaacacagacacaaccttatgtcctgcttccaaaacataaataatggttgtaaagcgtcccacacgttgacccaaagtctcctttgaaacaggaaattgagacacgccggttgtgaaacctactgaagtgagcggcggcgccagggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcacnccccccccnctgtccngccccccgccccnccccncgcccccccgcccccntcgcgcccccnccccccnnccgcccccccccccccctccccccccnnccccccccgccntcccccccncccccccccccccccccccccntccctccnccccacnngccccncncactccncagngcnccggccgcccccccccgtctcngangacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 58745 - DNA, 2795 bp, Homo sapiens
gagacatgtactgctaaagcaaggactttgatccttttttccctttgcatttttaccatggttggaattgtaacacagacacaaccttatgtcctgcttccaaaacataaataatggttgtaaagcgtcccacacgttgacccaaagtctcctttgaaacaggaaattgagacacgccggttgtgaaacctactgaagtgagcggcggcgccagggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcatagtgtatgtgtattatgttgaaaaaaactactctgagtaaggatatttctctcaaatggtcatcactttttttccttggaggaagattgtcatgaaggcatcccttccttcccaaaacgacaacggcaacaacaacagtctcctttacttacagctattaaaagagacaatgtagggaaagggccaacaccacttgggcaagcatgagctgcagcgattgatggtgatggtagcccagccatgctgtgttcttatcttagagaggacagagcaggaaacttacaggggtagcagacctttctgatgccaaagaaataaggaggccaaaatcatgtttgcctagctgggaggtaaatctcttggcagtcagggtccctgaacacccagaaaaaataagtgagacttaacggttggagagtgtttgcttgagaaaagtaacatttcacactctctatactagacttgcacatatgaatttaggatgtgcgtgaagattctgctagcttcaacatatcccaaagcacttggatatgcctataatccaagtgctttgggaggctgagataggaggattgtttaaggccaggcatttgaaatc

SEQ ID NO: 58746 - DNA, 290 bp, Homo sapiens
ctgaatttgggatgcccaggcactgaaaacaagatggggaatctaaacttatgaggaatagaaattggggttttaagtggaggaggaaataagaagcacctggtaccctcacacatgcctagaccaggggattggatatatgtagagaggggtcctgtgctgagagacagcctatgttcctccagagcaggtgggagctacacctccatgggcttgattgccttggcagtcctggcgtgcttgctgttcctcctcattgtgggctttacctcccggtttaagaggcaaac

SEQ ID NO: 58747 - DNA, 433 bp, Homo sapiens
cctatagcaatgtatgcacacattgcttagcactgtaccatagagtactgatatgttacaagaatgttcatctcagaaatatgccttatgttaaaatagaatgaaaacagctgtatcttgtaccttctcagccaaagagctatgatcatttcactgtacttttctcagtgtgaatggcacgcccaatgtgtttgtttactctgcttctcttctatgccattacccatttatccatggtcaggttaccatttcctcccacctgaaatactgtgataaccttctaactgtctttcctactattccaccttccaaaaccacggcctgttctgcaatcgtaattatatagttgtaaacaatcacacctgatcatgttacctgcttgctgaaaacccagctgccatttattgctataaggtatggatctcagtcctcg

SEQ ID NO: 58748 - DNA, 318 bp, Homo sapiens
ccaggtgcaatctcggctcactgcgacctctgcctccgcgtagctgggactccagctgtgcaccacccagtcagccccacgcccaccctgccaggcgtgtgcacggatcagcgtcactttacagatgaggaaactgagtctttgggaagctgacaaggtgcctgacacaggccagggcagggcccaccctcatgggctgtgctgcagcctctgcctcgtgggtcacggcaccccatctacgaggagcccctcaaggatgcgccgtcgagtccccggggcccttggcatgtccctggcagagaaggcagctcagggtgt

SEQ ID NO: 58749 - DNA, 127 bp, Homo sapiens
attttaccctagagggcagcatggtgccgtggagcagtgcgagccagtgaaggacctggcagttaggactacattcttaggcacaccttttcccgtcctgctggcccacttcccttctccaatacct

SEQ ID NO: 58750 - DNA, 348 bp, Homo sapiens
taacaaaatgatttgcttgtgtttgtgtgagtggcttgtttgctctggaccagacagaaggctaaactgtcattaaattatgcttagaatgagaagaactggttaatgtatccaatagcaatagttaatatactggttgtaatgaggatgatatccaattatctattctaaccaaagaaaatgacagaaaaaaaccatcattctttagtcttaagaattgtgttttaagaagtttgaaaaacccaaacattggcccatatgccttctatgttaacctagtctagaaacattttgatatgcaagggggttaatattaatgaaaaatataggaagataaagttttatata

SEQ ID NO: 58751 - DNA, 468 bp, Homo sapiens
atcctcactcccttcaacccgagcacacgtggcccttgtctgagcttccctggaccccatatcgcttctcagcttgggtccctttctctgttccctgggtgttgcccacacccaccatctcccctgtacttcagctcactcctgtcaggctcccacccctctgctccacggaaaccctcctgctcaggcggctgaggcctgggggcctgcaagttcccaaaccctggggccaccagacaaacccaaagtgagtgagattctacagaataactggcctcagctcttcagaggtgatgaggaaacactgaggaccgtcacaggctggtggggagtaaggagacaggaggacgaggtcacgttagtgccatcttggattggttcctgctccaggacaaggactttaggacaactgacagaacttcaataagctgtgcagattaattagcagtgtttatgtcaatattcaaa

SEQ ID NO: 58752 - DNA, 252 bp, Homo sapiens
tcacgtaaacctctgaaaagaaaactgctgttgatttggactctggataccattacccagctcacgctccttgctgtgacgactcatttggactcatacacctgcccagggcatccatgtacataatcctgtgaatcaaaggcaggagagcacccacatggacactcgggtctgtggcatccccaccaaatgatgactcatcaccagcttgaagacctctgctttttctgctcggcaaggagaaacgtggct

SEQ ID NO: 58753 - DNA, 235 bp, Homo sapiens
tggtaaattctcagatgggtggacaaaatatgatgatgctgattgccttgctttgaatgggacactggtaagcctccaatagtggggttagagttcaatataggtgttttcttgaagcctagagtcaagtaatggagaggtaagagcaatttgattgggtttgaaagaaggtgatgtccaaaataagtcacttgtttgaagttttgtgttgagtgatggtgaactcaaagatctt

SEQ ID NO: 58754 - DNA, 338 bp, Homo sapiens
gaaggagcggggaaccagtttctcactctcctcccacttgctattgtcagaagagcgagatttcagggcagcagagagcatcaggagatcaaaagaagacactgctgggtggtcccttagcaagttttagcttctttgcctgctgggagagtattccttgggcacagtgccaagtgtctctaagaaactagtcatgcctgatcttaagggctcgcggattctgggtggtggatttccttaggcttgtctgagcctgccagtgctctcctctgtcgctctgatttccattcacgctgagcagtctgcactcccttggacagacccactggcattttggg

SEQ ID NO: 58755 - DNA, 393 bp, Homo sapiens
gtgggtgtgggtctcactatgttgcccaggctagattcaaactcccaggctccagtgatcctctgagtagttgggactgcaggcatgcaccactgcccccagctttttcctgtcttgttctgattagaattaaatcacaggttttttgtttttgttttttatctttccataagtacagttaaagtaagattctcagggcagctcctgagttatcgtccctttttgctaaaatagatatttttagccaagagtttatgagtaaagaagctattcctactggccaagcgcagtggctcacgcctgtaatcccagcactttgggaggccaaggcaggcagatcacctgaggtcaggagtttgagaccagcctggccaacatggtgaaacctcgtct

SEQ ID NO: 58756 - DNA, 303 bp, Homo sapiens
catattgggggcccaatataaagcaaagctggaagcagggatgatccatgtatttgtggggatgggatatggacagggaaatagtgttccaactccatgctgagtgttgttttgaattgtaatgtgaagttgccaccataccagggctatgactgtgtacgatgtctcacccttgtaggctagtagctttgcagtgggaaaagatgacagggccacttgtccagggcattcaggtaataaagtccctgagctccaagttgctagatctaaggaagtattttttccttcatgtcaaagatgggg

SEQ ID NO: 58757 - DNA, 385 bp, Homo sapiens
aagggctcagtaaatgatgttctgccctatagactggccaggagctaaaggatattccaagagccagtcactgacctgacctctcttctgccagtctgaaagagactctattttagggaggaagcttgctttcatttcctagcaaacattctgggcctcagacaaagagctttaaaggttagaaaccttataaaatgatgccttgctcttgtgagaggagcctacctagagtccagcttcagttcttgagctaaatacatttgttttatccaaccacctactcaagctcagcatagggggcattccaggtaaattgatgataacagctctacctctagtgactttaaaatctcattgagttctgtaggccagggttaattaaaag

SEQ ID NO: 58758 - DNA, 771 bp, Homo sapiens
  misc_feature (26)..(26): n is a, c, g, or t
ccgggctgcaggaattcggcacgagnactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58759 - DNA, 288 bp, Homo sapiens
cgtccagaggatcccctctctccaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgtgccagtgtggagagaggggatcctcagagtcacctcgc

SEQ ID NO: 58760 - DNA, 2188 bp, Homo sapiens
tttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaa

SEQ ID NO: 58761 - DNA, 324 bp, Homo sapiens
tcggtaccttcgacggtgtctgatcttagttatttctgtcttcactagcttttgaatttgtttgctcttgctctcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccgtcagaacggggtaccgacgctc

SEQ ID NO: 58762 - DNA, 259 bp, Homo sapiens
  misc_feature (40)..(40): n is a, c, g, or t
gttcgcaacggtcgctctacgacggatcccggccccccgntggattgagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaagatttgcgccagtatagtcacacgatttccgg

SEQ ID NO: 58763 - DNA, 226 bp, Homo sapiens
  misc_feature (40)..(40): n is a, c, g, or t
gttcgcaacggtcgctctacgacggatcccggccccccgntggattgagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaa

SEQ ID NO: 58764 - DNA, 2406 bp, Homo sapiens
tgagatggagcttgctctgtcacccaggctggagtgcagtggcacgatcacagctcactgcaacttccgccacctgggttcaagcaattttcctgcttcaacctcccgagtagttgagattacaggcacgtgccaccacacctgactgatttttgtatttttagtagagacagggtttcaccatgttggccaggctggtcttgaactcctgacctcaagtgatccacccacctcagtctaccaaagtgctgggattacaggttgtgagccactgcacccggcctctgtctgacttttaaatgatggagtatcccagaggtcaggctttagagctcttctttcttccatctacagagtgctcatttctttggtgatctcattcagtctcacggctttgaatgttatatgctgataagtcccaactttctctgtctcgcctaaacttcccctaatagcagaacctgatatcaaagtgcctatttgacatctccacttagatatctaataagcatctttaatgtaaaatttccaaaactgagctcctacaattccctcccacacttgttcagttttccccatctaagctaatggcaactccatccctccagttgctttggccaaaacttttgagttgtctttgactgctttttttctcccttcttacattgtgctcatcctttctttcaggcaaattctgtttggtataccttcaaatatatctagaattctatacttctcactacccctcattcccattatctttgaaacacactccaatgaggtttttacccccactattccaccaaaaacactcttgtgaaagtcaccagatgatggttcttcaggctatcatctgtctcctgaattattttaagagcctccctaactggtctccttgttccagcccctgctcccttcactctattctcaatacaacagtcagagggatcttataaaaccgtaagtcagatcatataattctgtgtgaaaccctccaatgttatcccacttcagagtaaaagttaaagggtttattttgatctctaaatattttgatccctatgatctagtctcttcttacccaaagtatgggcctcataccagcagaactggcattctctgggagcttgttagaaatgtagaatctctggtcctaagattttctaaatcagaatctgcattttcatcagctctcttggcaattcatatgtttgagaaggactgatgtagtcctctactgcctctcctgctgctatgtgctgctctagtcacactgtcctcctggctatttcgataagatggaaactctcctgcctcagggcttttgcacctactgctccctctgtctaggataatcttccccagaaaactgcatgccagttgccttatttccttcaggtctttattgaagtcactttctcattaaacactttctggcccatcctgtctaaaactgcatccccaaacccttcctatcccttttctccacttttttctttttttaaactatagttcttatcaacatagtatatgttttgcttatttatcctgtttattgtctgactcaacattgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58765 - DNA, 266 bp, Homo sapiens
  misc_feature (11)..(12): n is a, c, g, or t
atagaaaaccnnttttacaatttatttcctgttgttaatctttaaaaatgaggttctagctaagtgcagggtttcagtggtgaaattttgaccatgtgaacacataaataaatatttgttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58766 - DNA, 327 bp, Homo sapiens
ctcgtgccgctcgtgccgaattcggcacgagggttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58767 - DNA, 315 bp, Homo sapiens
tggccggccccagatttctagttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58768 - DNA, 252 bp, Homo sapiens
  misc_feature (234)..(234): n is a, c, g, or t
tcaaaatcatacaaatagtgtatgtagtaattttttattatttcattttaaatcacctaacaactgacttctttactcgcaggcatgcccggaagtccaggaggaccaggaagtgatgggaaaccagggcctcccgtatgtacatttttaaaatctcattttaaaaggccagttaaaatggaatgtatatgttggcctcccaaaatgctgggattacaggcgtgaccaccacgnccagcctggattcacttt

SEQ ID NO: 58769 - DNA, 327 bp, Homo sapiens
  misc_feature (196)..(196): n is a, c, g, or t
  misc_feature (274)..(274): n is a, c, g, or t
  misc_feature (297)..(297): n is a, c, g, or t
caatcaccttggagcctttcggaggcaagggtgatgctggtgcccctggtgaacgtggacctcctggattggcaggggccccaggacttagaggtggagctggtccccctggtcccgaaggaggaaaggtgctgctggtcctccaggagaaaatggaaaacctggggaaccaggtccaaagggtgatgccggtgcncctggagctccaggaggcaagggtgatgctggtgcccctggtgaacgtggacctcctggattggcaggggccccaggncttagaggtggagctggtccccnttggtcccgaaaggctccaagggtttgggc

SEQ ID NO: 58770 - DNA, 5031 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58771 - DNA, 4887 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58772 - DNA, 3911 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58773 - DNA, 868 bp, Homo sapiens
gcaggctggtacggccggagttttaggatcaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58774 - DNA, 5313 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58775 - DNA, 5700 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctagagaaccccacggttataaaaacccgctaaaatccggaaacccgggccccggaggggaaaggatgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58776 - DNA, 6151 bp, Homo sapiens
  misc_feature (5741)..(5741): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattcaaaaaaaaaaaaaaaaaaaaanaaaaaaaaaaaaaaaaataaaaaaaaaaaaaaaaaaaaagaaaaaaaaacaacaacaaaaaaaaaaaggggggggcgcccacaaaaaatccccccggggggcgccccttaaaggtccccccctttttttttacaaaaaggggccccccataaggaggtctcaatcaaacatgagccgcaccgggggcccgtgatataaacaccaccgcgagaaggcggaaacactcgctgcacgtgggcgacttaggagaagaagcgcccacatctagggggggggcacacaacaaggggcaaaaacaccacgaagaaatatactacggccatcaggcgaagagcataaaacggcaggtgtataggtgcgcaccggcttccaagtactgcccgacaaaaagctgcgcccacgggcgacga

SEQ ID NO: 58777 - DNA, 765 bp, Homo sapiens
tcggtatgaacagggaacacgttgtagcagcgaacgagtgcagcgaagaaacacgtttggcttgggagagtccatggaatggtggtctcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58778 - DNA, 725 bp, Homo sapiens
gagctcggtacccttaggataccccattatgtgatggatggtgcttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58779 - DNA, 6457 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58780 - DNA, 5361 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaggagcacctttacaagcagctgatatccaatattaaaataattgtggcgtcgaccggttgttaatttagtagtagtaggccgc

SEQ ID NO: 58781 - DNA, 5638 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaaataaaaaaaaaaaaaaaaaaaaagaaaaaattttggggcgccgccgcgcccccaagaaaaagaaatttaacagaaacacagcagttgtgtggcgcacgcgcgcccacaagaggagaaagaaaaaagtgaccaaaaaggtggtccccagaagagaacccgcggacacacacagcggcggggagatatcccccaaaaacaacgaccccccgggggaaccacacacagcgtgtttgacagacaaacccccagaagagagagtctataggcagcccaaaacggggaacctcatacaacagggggacgtcacaagagagcagtgcaagataaacaaatatcaccccgccgacacgggggggagacgcgagcgcggagaagtacatacgtagcagagcctgacagagcacatcgaagaacaaacgcacagagaccagaacggaaagaaaggcatgcgcaaacgacgaccgcaaagaaagagatgaagcgcagcgagcaaggcagcgaagaacagaacacagcaagcagcacagactgaacggaatgcagaagtcaggacacgagagagctaccaacccacacagcacagcggaacgaaagaaaaaca

SEQ ID NO: 58782 - DNA, 1260 bp, Homo sapiens
  misc_feature (26)..(26): n is a, c, g, or t
ccgggctgcaggaattcggcacgagntcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58783 - DNA, 1273 bp, Homo sapiens
ttagacatgatacgactcgagttcggtaccctcgataagtcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58784 - DNA, 5769 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58785 - DNA, 1182 bp, Homo sapiens
  misc_feature (26)..(26): n is a, c, g, or t
ccgggctgcaggaattcggcacgagncaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58786 - DNA, 1142 bp, Homo sapiens
cgtccagaggatcccctctctccaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58787 - DNA, 4777 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaa

SEQ ID NO: 58788 - DNA, 4782 bp, Homo sapiens
  misc_feature (4716)..(4716): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttgntgggatttagatagagtttggtttataaaagcaaacgggccaacgtccacaccaaattcttgatca

SEQ ID NO: 58789 - DNA, 4853 bp, Homo sapiens
  misc_feature (4787)..(4787): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgttttaaaacacaggaaaaagtaagaacatgagtagcgcactgacgcgagcaggtacgtcgtcgaacggggcccaggatgcgatcagaggacaaatataggaggtaaattctctttcntgggatttagatagagtttggtttataaaagcaaacgggccaacgtccacaccaaattcttgatca

SEQ ID NO: 58790 - DNA, 4758 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttc

SEQ ID NO: 58791 - DNA, 4715 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaa

SEQ ID NO: 58792 - DNA, 4472 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcataaccttttgcttcagggaagcacggttctt

SEQ ID NO: 58793 - DNA, 4381 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtctctctagctgaataatctcaa

SEQ ID NO: 58794 - DNA, 3922 bp, Homo sapiens
  misc_feature (3913)..(3913): n is a, c, g, or t
  misc_feature (3919)..(3919): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggagggggatcctcaagcgaccncggacnaac

SEQ ID NO: 58795 - DNA, 3961 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggcctgttgtcagcagggtgcaatcggtcgtccaggaactgtggcccagaggacctgttggcccagtggactcctgggaaggatggacctgtgggctcccgtccttggaccacgggtcttgagtgaccggggtgagacggttgggggtcccagggccctggcgcaagcctcttgcctctgtgcctggtctgttgtgtttggccgctgtggtggtggtactcgtttccgtttgggactgttaaaccggttttc

SEQ ID NO: 58796 - DNA, 3725 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctcctggttccgaggtgctcgtggtcgtcaggccacgtggtgacaaggtaaacaggtaacgtgagctctgcagtaaggacataggattcctgtagtcaggtccaggttctcagggcctctgtaaggggtcaatgaagttcagaccta

SEQ ID NO: 58797 - DNA, 3138 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagta

SEQ ID NO: 58798 - DNA, 3065 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagtcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcaacaagaaccccaaggacaagaggcatgtctggttcggcgagagcatgaccgatggaattccatttccagtttggcgggcagggcttcgacccttccgatgtggccatccagctgacctt

SEQ ID NO: 58799 - DNA, 532 bp, Homo sapiens
cactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaattgatcaggtatccatcgtatcagaataatgacatctgcc

SEQ ID NO: 58800 - DNA, 287 bp, Homo sapiens
ccgggcccggctggggcccatgtagaggaggacagatccaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttccccgcccctcaacccgcccggccc

SEQ ID NO: 58801 - DNA, 776 bp, Homo sapiens
  misc_feature (70)..(70): n is a, c, g, or t
gtgtcatcagagtaagaagatatagtacagagaaaaacacgtaggttgagagtccatggatggtggtttncagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctagaaggcgactatggacgagagccgggccctttctgtgagatacgccccagataagaagggaatg

SEQ ID NO: 58802 - DNA, 4932 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58803 - DNA, 3558 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58804 - DNA, 5719 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58805 - DNA, 5764 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataaataaacttcaacactctttatgataacaacactgtgttatattaataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58806 - DNA, 6358 bp, Homo sapiens
  misc_feature (5741)..(5741): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattcaaaaaaaaaaaaaaaaaaaaanaaaaaaaaaaaaaaaaataaaaaaaaaaaaaaaaaaaaagaaaaaattttggggcgccgccgcgcccccaagaaaaagaaatttaacagaaacacagcagttgtgtggcgcacgcgcgcccacaagaggagaaagaaaaaagtgaccaaaaaggtggtccccagaagagaacccgcggacacacacagcggcggggagatatcccccaaaaacaacgaccccccgggggaaccacacacagcgtgtttgacagacaaacccccagaagagagagtctataggcagcccaaaacggggaacctcatacaacagggggacgtcacaagagagcagtgcaagataaacaaatatcaccccgccgacacgggggggagacgcgagcgcggagaagtacatacgtagcagagcctgacagagcacatcgaagaacaaacgcacagagaccagaacggaaagaaaggcatgcgcaaacgacgaccgcaaagaaagagatgaagcgcagcgagcaaggcagcgaagaacagaacacagcaagcagcacagactgaacggaatgcagaagtcaggacacgagagagctaccaacccacacagcacagcggaacgaaagaaaaaca

SEQ ID NO: 58807 - DNA, 712 bp, Homo sapiens
  misc_feature (24)..(24): n is a, c, g, or t
  misc_feature (31)..(31): n is a, c, g, or t
ccggtaccgaagctcactctatgnatggtgnttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58808 - DNA, 706 bp, Homo sapiens
cggacacggcgagaccaggacggggctcacagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 58809 - DNA, 5623 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58810 - DNA, 5604 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggaaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 58811 - DNA, 5344 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaagacaaaaaacagcaagaacacactgtgtgggcacactagagacccagagagaggtttgtaaacacacatccgtatggggcacggggagcccacgtaggaggtatggtgaacaaggcgcgcaaaagcggtgtgccacgaggagaaaaactcggggcgcaaaacacaaggggggggattctcacagaataaaaaagcccgggggggacacaccgggacggttcttgaaacaaatcacaaaggagagtccggaggcacacaagaggagatcaataacagagggccacaagggaggcgcgaaataaataca

SEQ ID NO: 58812 - DNA, 5021 bp, Homo sapiens
  misc_feature (5008)..(5008): n is a, c, g, or t
  misc_feature (5017)..(5017): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctacagggggccggnaccgagctngata

SEQ ID NO: 58813 - DNA, 5049 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctagccatcggaaacttcgccatcggaaacttcgccatcggaaacttcgccatcgg

SEQ ID NO: 58814 - DNA, 4993 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccacttgttttgtcactcacgggtctggcctgccgagataagctccatacactcggcattagctgtttc

SEQ ID NO: 58815 - DNA, 4793 bp, Homo sapiens
  misc_feature (4681)..(4681): n is a, c, g, or t
  misc_feature (4701)..(4701): n is a, c, g, or t
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtttaaaaaggnagaaagaagaaccatgggtngtcatgacgcagagtatggtgtggacggtggccctggattgcgacagaaaacaaatatatggaaatcccacgtggatttaacaagtggctct

SEQ ID NO: 58816 - DNA, 5515 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaa

SEQ ID NO: 58817 - DNA, 4654 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgtgatcttctgcacgataggtgatcttctgcacgataggtgatcatctgcacgat

SEQ ID NO: 58818 - DNA, 4465 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccgtcagaacggggtaccgacgctc

SEQ ID NO: 58819 - DNA, 4333 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacctccagctgaaggtgacgagaagaagtcagaatcatacagttactaa

SEQ ID NO: 58820 - DNA, 4173 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatt

SEQ ID NO: 58821 - DNA, 3407 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagta

SEQ ID NO: 58822 - DNA, 3355 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccagatttaaattatatgttttgtgctctcatttattatcatttttttctgtacaaatctattatttctagatttttgtataacatgatagacataaaattggtttatctcctccaaggcagtttgtctttttctattcctcccccttcaacctgtgtcacaaaagaccaagaacagatgtcggaaaagttgttttttcttcagtatagtttcaccttccaatacagaataagttataaataaaaggcttgtatgt

SEQ ID NO: 58823 - DNA, 2787 bp, Homo sapiens
accccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaactggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggtgaactagggagcagagagaggagtggggaagtgtcagacctctggcctatgggagtcatggagagctgaaaagaatgaaaacatcatacaaacattgttatttcaggaaatgtgactttcctatgaggattttaaaaatcctaaaggcattcaactt

SEQ ID NO: 58824 - DNA, 674 bp, Homo sapiens
cccatataagaatcaggaaacgaagacttagaagtatgtaatgtgccaatgatccctgaatttagtaccctgttagattagggtaagggaagttgaagagtttagaatgactcccagttgtctataatgggtgattggggcagattgggatgttcagttttagaattaagtttaaataccagtccaagtaaagatgttagaatgctatgcaaatctggagttaaggggagagagctaagctagagataaatacttctagttaaagagtggtcattaaaagccaggagaggccgagtgcggtggctcacgcctataatcccagcactttgggaggcctaagtgggcggatcacgaggtcaggagattgagactgtgttggcccacagagtagagaccactcacacaatgggagaaaatatctgcaaactacgcatctgacaaagcactagtatccagaatctacaaggactcaacaaatcagcaataaaaaaccccaaataatcccattaaaaagtgggcaaaggacatgaatagacatttctgaaaaggatatataaaaatggccaacatattaaaaaaatgctcaacatcataatcatcagggaaatgcaacttaaagccacagtgagataccaccttaatcccagctacacaggagacacaagggaacaccg

SEQ ID NO: 58825 - DNA, 412 bp, Homo sapiens
cccatataagaatcaggaaacgaagacttagaagtatgtaatgtgccaatgatccctgaatttagtaccctgttagattagggtaagggaagttgaagagtttagaatgactcccagttgtctataatgggtgattggggcagattgggatgttcagttttagaattaagtttaaataccagtccaagtaaagatgttagaatgctatgcaaatctggagttaaggggagagagctaagctagagataaatacttctagttaaagagtggtcattaaaagccaggagaggccgagtgcggtggctcacgcctataatcccagcactttgggaggcctaagtgggcggatcacgaggtcaggagattgagaccatcctggctaacacggtgaaaccctgtctctactaaaaat

SEQ ID NO: 58826 - DNA, 356 bp, Homo sapiens
gggatagcattaggagatatacctaatgctaaatgacgagttaatcggtgcagcacaccagcatggcacatgtatacatatgtaactaacctgcacattgtgcacatgtaccctaaaacttaaagtataataataataaaaaaaataaaataagagctagtttgaattagaaagcaacagacaccaggaaaaatcttgtcaggaaaaagaatagatatttgatgagtagcagcattgagttcaccagcagcaggcacctgaaaagacattgcggcgggggttttggccaaaacatgtctgtctgccctctaagcagggtggccttcttacctcatgtatttctgatttgattttct

SEQ ID NO: 58827 - DNA, 611 bp, Homo sapiens
tggaatgtagctaaagcagtgcttggagggcaaattatagtttaaatgcttttattataaaggaagaaaagtctaaatgtcagtaaccaaagtttctaccttaggaagctagaacaagaacagcaaagtaaacctggagtaagtacaagtaaggaaacaatagagtaggaatcaatgatgtggaaaacagataatagagaaactttaaaaagccaaaatctggttctttggtaagatcaacaacagtaataaacccttatcttcagtgaacaagaaattgacaatgcgacatgttgtaatagtaaaggaataaagtacatagtgtggaacacagaggctgatctgaatttggttttcaaaggtggtttcagagaggtggtaaaatttgtgtttggctttcaagaattagtgtaagtttttcctgatacagattgggaaaaagaatattctgagaggaaataagagcaaaataattttatttttcaggcttttggcatatttagaaccgtatttttatttttttgagacagaggctgcagtgagccaagattgcgattgcgccactttactccagccttggcaaaagagtgaaaatccgtctcaaaaaaaaa

SEQ ID NO: 58828 - DNA, 574 bp, Homo sapiens
tggaatgtagctaaagcagtgcttggagggcaaattatagtttaaatgcttttattataaaggaagaaaagtctaaatgtcagtaaccaaagtttctaccttaggaagctagaacaagaacagcaaagtaaacctggagtaagtacaagtaaggaaacaatagagtaggaatcaatgatgtggaaaacagataatagagaaactttaaaaagccaaaatctggttctttggtaagatcaacaacagtaataaacccttatcttcagtgaacaagaaattgacaatgcgacatgttgtaatagtaaaggaataaagtacatagtgtggaacacagaggctgatctgaatttggttttcaaaggtggtttcagagaggtggtaaaatttgtgtttggctttcaagaattagtgtaagtttttcctgatacagattgggaaaaagaatattctgagaggaaataagagcaaaataattttatttttcaggcttttggcatatttagaaccgtatttttatttttttgagacagagtcttgctggagtccatcggtgcaatctcggctcactgtaacc

SEQ ID NO: 58829 - DNA, 215 bp, Homo sapiens
tcagaaacacaagagccgaaaacgccggtaagttgccaaagctggtggaggggaggggaagagtgggcagaaataccaggggtgcaaactccagtggccccggggcaagcaggtaacaaccagctgggtgcaccagcacacatgagctactggccctggttttagagggagaggtggacaatggccaggtggagagagccctctcacagcatcca

SEQ ID NO: 58830 - DNA, 596 bp, Homo sapiens
  misc_feature (47)..(47): n is a, c, g, or t
gacagcgcagggggaacccagggagcgcgatgggctgcagggctgcntcagggctcctgccaggagtggccgtggtcctcctgctgctgctgcagagcacacagtcagtctacatccagtaccaaggcttccgggtccagctggaatccatgaagaagctgagtgacctggaggcacagtgggcacccagcccccgcctgcaggcccagagcctcctgcccgccgtgtgccaccaccctgctctgcctcaggaccttcagcctgtctgcgcctcgcaggaggcttccagcatcttcaagaccctgaggaccatcgctaacgacgactgtgagctgtgtgtgaacgttgcgtgtaccggctgcctctgagatagccctgggtaccctgagcccaccagggacacctcgcccttcagcccaccaccctggcaggcttccatccccgtccatgctcaagatgggtccctggccaccatggtcatcaccacccttccagggcctgagcagctggatctggtacaaagcaatcggacatagagttggagggggaggcccctgaggcagcccagctcctgaataaagattctacaacacacg

SEQ ID NO: 58831 - DNA, 5035 bp, Homo sapiens
cgcccagcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58832 - DNA, 4800 bp, Homo sapiens
cccacctcggcctcccaaagtgctgggattacaggcatgagccactgctcccggccacttatttattagtcacttaatcattaatagtgctgttgatagcaactcttcccaaagtcacttgaagggttggggtgtcttcaccttcagaagtggtgacctggctccccagtgcctgacaccactccctgctccccatgccagggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58833 - DNA, 5414 bp, Homo sapiens
cgcccagcgcagccggagtatccacctcgatgaccacgggctgagccccgcgccgccaccatgtccgtggccttcgcgtctgcccggccaagaggcaaaggggaggttacgcagcaaaccatccagaagtttttgaagaatgccggccagtcatcgagtgcccttggtttgggtacaaggtgcgttttcctaacttgcgggtctgaaagtgcgtccattcccccttcacgcctggttgcggtttcggcggactagaatttctacgcagaagtctccctcaggatcagaccgtagcccttccggaaacctccatgatgctggacgagaaccaccacctgatccagtgcatcctggagtaccagagcaagggcaagacggccgagtgcacgcagtgagtgcccgccatacaccggaacacttggagggtgtcatgcagagtctaagcacagaggccagatacgtcccaagagtcccccagcacagagatcagataagtcccaggagtccccagcacggaggccagatatgtcccaggagtcccctgcacagaggccagatatgtcccaggagtcccccagcacggaggtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58834 - DNA, 4746 bp, Homo sapiens
cccacctcggcctcccaaagtgctgggattacaggcatgagccactgctcccggccacttatttattagtcacttaatcattaatagtgctgttgatagcaactcttcccaaagtcacttgaagggttggggtgtcttcaccttcagaagtggtgacctggctccccagtgcctgacaccactccctgctccccatgccagggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58835 - DNA, 5220 bp, Homo sapiens
cgcccagcgcagccggagtatccacctcgatgaccacgggctgagccccgcgccgccaccatgtccgtggccttcgcgtctgcccggccaagaggcaaaggggaggttacgcagcaaaccatccagaagtttttgaagaatgccggccagtcatcgagtgcccttggtttgggtacaaggtgcgttttcctaacttgcgggtctgaaagtgcgtccattcccccttcacgcctggttgcggtttcggcggactagaatttctacgcagaagtctccctcaggatcagaccgtagcccttccggaaacctccatgatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58836 - DNA, 3988 bp, Homo sapiens
cccacctcggcctcccaaagtgctgggattacaggcatgagccactgctcccggccacttatttattagtcacttaatcattaatagtgctgttgatagcaactcttcccaaagtcacttgaagggttggggtgtcttcaccttcagaagtggtgacctggctccccagtgcctgacaccactccctgctccccatgccagggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58837 - DNA, 3529 bp, Homo sapiens
  misc_feature (117)..(117): n is a, c, g, or t
  misc_feature (122)..(123): n is a, c, g, or t
  misc_feature (131)..(131): n is a, c, g, or t
  misc_feature (142)..(143): n is a, c, g, or t
  misc_feature (147)..(147): n is a, c, g, or t
  misc_feature (152)..(153): n is a, c, g, or t
  misc_feature (156)..(156): n is a, c, g, or t
  misc_feature (167)..(167): n is a, c, g, or t
  misc_feature (178)..(179): n is a, c, g, or t
  misc_feature (183)..(183): n is a, c, g, or t
  misc_feature (187)..(188): n is a, c, g, or t
cagtggtccattacaaagatgggtaatgcagccatgggaccagcatagatggatatccgcccttggtgccttcgggccttacagctaaggtgctaccagcagtccctgagcaggagnagtannatgccgancagtacagcannagcnagggnngcngcgagcccatnggccagcagtnntacnccgnnggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58838 - DNA, 2392 bp, Homo sapiens
tggtcttgaactcctgacctcaaatgatccacccacctcggccccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatagtatgattatacatatcacaacactgaaccgaacaatcacaatatatccaaaatatacactaacatctgcctacgcatttccctcacctccccaccaccaacttcctaactcgacacgcaacctctccatactccatagacccaacatacataaaagcacacagcaacacacaccacatctcacaccttctacatacaaagacagctccaactacagacccaaaccacaatgacacacctcttcactatcactctcctctctcacaatctctcgtcatacacaatccatcgctcattacatcatactccccatctgtctcaactccgctacccacacacatttctccctctcgtacactcaccatatgatccaccacacaccaccgtgatcatcctccctcctaactgtaacacacaa

SEQ ID NO: 58839 - DNA, 405 bp, Homo sapiens
aaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagttaacgggattttggtgtgatgtgttttgcaaatacttattaccgagaccaggtagatcgtcacctcggctcccgggcagagttcgcgtgcgtccgcaccggattccccgcggcggcaaggcgaagccagggtaagggcggtggggacggcgccccggggctgccctgcggtccccactgcctgctctgcgttgccccgta

SEQ ID NO: 58840 - DNA, 406 bp, Homo sapiens
ggtaacaggtttttaccaacaattgcttgtagctaatgtagaacatacttgagaaaatggcttctgtgaaagaccagttagtaccaaaataatctggcccagaaaaatagccaccattcttgactacattaatagaaatagaataacccccaaagggagatgagaagcattctaaagtgcactgatcatgagtttctatgtgatgatttgtgtccatttggagctccagtgctttaaagctgaaatgaaccctggcctttcaccaccctccctgcccatagtatggtatatcctcttattccttccctcttagcttactgagagtgtaatttccaaccagttaagccaaagaggactattttctagaaaaggagagagagaatgaattagcagataaatgaagagt

SEQ ID NO: 58841 - DNA, 496 bp, Homo sapiens
aaaaatcaaaaggactggttcagaaagtttctggattgctgaacacatgtaagatcgtggagggtctcactttgtcaaccaggatagagtacagtggcatgaacatggctcacagctgcctcaacctctcaagctccagcgatcctccctcagcctcctgagtagctgggaccacaaggatgcgccaccacccctggctagttctgttcattttttgtagggacaaggcctcactatgttgtccatgactcaagcaatccttctgcctcagccttccaaagtgctgggagtacaggcgtttgagtcaccgtgcctggccagatcttggtttctaatgccattatccaataaaaggaatggggactccttggagaaatgactgattctaggagccgggcaggaaatatgcaagatgagcctggagcattttgtagtaccacaaagtaggaaagtattaaaatacacacacacacacacacacacacacacacacaca

SEQ ID NO: 58842 - DNA, 301 bp, Homo sapiens
cttcatatttttatagctggggtcaaaatatgcaatttaaaaataaatatatccatttgcctattcttacatttatgaatataaaaataaaatctaagaaacataatgctgccaactaatagtagtggaggaaaggaagctgagagaaagataaatatattaatttaatcattactcagaaaaggcagtaaaagatactatctatagcaggcatcaataaatatgaaccatgagccaaatcaggcttaccacctgattttgtagataaagttcattgaaacacagttacagtgtctttcaa

SEQ ID NO: 58843 - DNA, 364 bp, Homo sapiens
gctccactgaccagctgttccctgtctctccttctccttgagcctccctcttccctgagacacaataatattaaaatttggccaatcaataactcaacaatggtgtctaataattgttcaggtgcgaggaagaggcatacatctctcactttaaatcaaaagctagaaatgattaagcttagtgaggaaggcatgtcaaaagccgagacagaccaaaagctaggccttttgtgccagttagctaagatgtgactataaagaaaagctgtcgaaggaaatttagaatggtactccagggaacacacaaatgataaggaagcaaaacagccttactactgggatatggagaaaagtttcagcttgg

SEQ ID NO: 58844 - DNA, 359 bp, Homo sapiens
ttggttaagaccaaagtcagatcactccctcctagctccaaacctgcagtggctcccaattctctcagcatacaaacccagatcctcaggctgccatttctgggctgaatcctgtccctgctgtctgatcccaccagacataatggaggcctgaggttccctgaacactcctagtttagccttaagttaagtatttgcacatgctggttcctatgcctgagataatgttccacatttcatcccattgcttgccagaaatagaaacccttccacataattccaaaacagaatttacaacacagagctttgggtgactgcaggacctccaagaacggtaggcagaagggacactgaagagt

SEQ ID NO: 58845 - DNA, 376 bp, Homo sapiens
aaaaaacttctggatccgcaggaatcagtggccaacagtccttgctgggttcagatatcttcagggaaatatcggtggtggtggtattcatgtttgaccttcagtgtgtatctaacacccagtagttctattatcaggtctcatttgtagattatgaatatatatgtctgtagatcatgagtatatgtgtctaaaggctacattgtggagcttatggtgcttgtgttctggtgacaaacttgttaaaacaaagttctgtggctaggcacagtggctcatgtctgtaatcccaacactttggaaagccggggcgggaggatcacttgagccctggagttcgagagcagcgtgggcaatatagtgagaacctgtgttt

SEQ ID NO: 58846 - DNA, 397 bp, Homo sapiens
agccataagctaccttgttgagggttaattagaaatactactcaattctgaccacagggagaatggcctgcaatgaggttttaagcattcatgtattcattcaaaaaatatttattgagcaccaactatgtgataagcagaggtctaaactttttggatacataagtgtacaaaagaaccaaaaattccagccatatttatcagaatatactgtgctttgtgttttagttgaatcagggctttgcccaagtgtcgctctctacaaggcactgtgggacaatattgttggaatacccaagacatggaaggcatggtctctgatatcaaagtagcaatttcaccaaagttgtcagatttaggggttagcatcccagcccttgtgacaccagcagtgctt

SEQ ID NO: 58847 - DNA, 208 bp, Homo sapiens
gaaccaatttctagtgcagcttatagaaataaaccatagtagtttacagccaaattgcaaattatagcttgtggcttttctcaatttatagtattaactactcttaaaaatttactattttgtcacataaaatatgatttagaatacttatgaaatatttgacttcttttgtacctaaggcatgatctcaccaataaagagatcttaa

SEQ ID NO: 58848 - DNA, 2223 bp, Homo sapiens
ctggtgctgaggtgctctagaggatccgccaggtagattgcccaccataattgtatttgaaaacaattcagtattcctttgttttatctattatttatttttgagagagggtctcactctgtcacctaggctggagtgcagtggcacaatcacagctcattgcagccttgacctccctggattcaggtgatcctcccaccttcacctcctgagtaccttggactacaggcatgtgccaccacacccaggtaatttttgtattttttgccatgttgcccaggctggtctctcttaactcttgggctcaggtgatctgaccatctcggtctcccaaagttctgggattacaggagtgagccatactgtgttgtgttttagttgaaagggatatacacgtgtattttagaaatatgaaacaggataagaattacattaaaatcacccaagatcccaaccaccattaaagagtttgtgtaaatcttctggtctcttttctgtatacactttttaaatactggggtcatatttttattggtttatatgctatgttaaacatttttagcatttcctcctgttcttaagtctgttaagaggatagctccatcatattctgtgttctgcaaattatttctggacatttaaattgtaagaaaatggtcactgttaactaggctgcagtgattatcatttgttcataaatctttgtgaagatctttgggtactgccttacattaaaatctttttcaatttgaccagtaaaagtggcatgttagtaacattgtcattttcagtgttagattatgtagtactaagtttattttattttatttttgagacagagtcttgcactgtcgcccaggctggagtgcagtggcgccatctcagctcactgcaacctccacctcccaggttcaagcgattcttctgcctcagcctcccgagtagctgggattacaggcacccaccacgatgcccagctaattttttgtatttttagtagagacagggtttcactatgttgtccaggctggtctcgaacgcctgacctcatgatccacctgcctcggcctcccaaagtgttgggattacaggcatgagccaccctgcccgacctagtaatacttttttttttttttttttttaatgaacttaaatgtttagaatggtaagttcacggctccctaaggagtgttccttttggattgctctgtttggctccctccctgaaatcctatagtcagccactggtcccctcagagagttttacctctgatctttggggtgattctttgttcatatttatctgattggctttgttcttccaaaagtgtctgcacaggactgctaagagaacctaggcaagtcatttaatttttctgggcttcagtttactcattagcttcttttagttcccagatgctattactggaaagaataactagtaatggataaaaacctacataaatatttcctattttgccatcaaagtgctgggttcattttggtgtatttggcatccaagtacaaattaacagtttcccaaaatcctgattctttgacttttttatcttgatgatggaaaggaaggacacgtttacttgctttagtttctttccccttaactacccacttgctgagaggggtaggagcagggattggctttagagaaacaagatacagtgtagattagctaatgtttgcgcttaacaaaacttgtcctgtttaacttacctgagggttctgcagcctaccgcagtaattttagttcagctgttttcagatatattgccttgtatcttcgttctttcgtctcctatcctttttagaaatttatcacctgtttctctttcagcctgacttacaaaatctaatttttggcctaaaaatttcccctagcttggtactagtccttttatttctgcctgtgattatattttaaaattaaacttaaatgaatctaattcattggatataaaaaaaaaaagtaagtggcttgctttgcttactctggttttccatcctcattcctggatataatcaagattgcagtaggctaacaatctaatgctgaaaacaagaatgaaaaacataccatcttttcaagttactttggacccatagagagaaagtggattggtacttaataccttccctgaatttaacagaattgatgtggactgtacataaaatatgttgaaaaataaaactatttttttggcaaaa

SEQ ID NO: 58849 - DNA, 1271 bp, Homo sapiens
gtgtccccagaagtggccttgaaccgaatatctccaatggacagggctggggagcccacagggctggtgcggcgggagtcagtggaggcgaagatgcagagtgccagctggaaggtcagaatacgctccaccaccatggcctggccctgcgttgtgttgttggtagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58850 - DNA, 1213 bp, Homo sapiens
gaatcaattcctccaaaccgcaagaacagtaacatttattattcaaaaaaacaaaaaccagattataggatatgacatttggtataacaataatgttattgaaaaatggaaaaatgatccattaatggcttgggctaaaaattcgggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58851 - DNA, 1462 bp, Homo sapiens
gtgtccccagaagtggccttgaaccgaatatctccaatggacagggctggggagcccacagggctggtgcggcgggagtcagtggaggcgaagatgcagagtgccagctggaaggtcagaatacgctccaccaccatggcctggccctgcgttgtgttgttggtagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataaaaaaaaaaaaaaaaaaaaaaaaaaacaaaaaacaaaaaaaaaaaaaacaaacatcacaaaaaacacactacacaactcaaccaacccccgcgcccacaacaaactaataacgggggcccaaattgggcctttttgggcaaattcccctaatggggggccttttactcacggggccccttttacccggggcg

SEQ ID NO: 58852 - DNA, 1551 bp, Homo sapiens
caaaactacttaaaaaacactgctctttccatttccgtatcatttaaccaaacaccatcctgtgggttctgtcacttgatcctcatgctgatctgagaactcggcagagctgggtcactgccttccccaaggctaacctggtttctaagctggcacaagaccccaggtgatctatcatctaaccacagagcccttgctggacagagggtgaagacattatgtgtccctggctctgttcagggaagcagaggatagacctgaagaatttaattacttgtcatagataaagcctagagaaaaggtgagggcgcaaagtatctcctccaaattgggaagactcccccagggctcactcactaacgccagttctcctgagcctttaaagcctgggggtgagggagccctcctggtcaaccctctctaccctagcctcagggagcttcagggccccagcattgaaggaacagggtctgacctcatttgccaccgtagggatggggagactgaggcaggaggtgaatgggctcccagcttggagccctttcccctcaggacttggtttccctaccctagctcctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58853 - DNA, 1242 bp, Homo sapiens
gtgtccccagaagtggccttgaaccgaatatctccaatggacagggctggggagcccacagggctggtgcggcgggagtcagtggaggcgaagatgcagagtgccagctggaaggtcagaatacgctccaccaccatggcctggccctgcgttgtgttgttggtagagcgcgttgtctaccctgtaccgaagacagaggctgtggggacagcctaggggcctggatctattgcctacttagagagaggccaactcagacacagccgtctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58854 - DNA, 1208 bp, Homo sapiens
gtgtccccagaagtggccttgaaccgaatatctccaatggacagggctggggagcccacagggctggtgcggcgggagtcagtggaggcgaagatgcagagtgccagctggaaggtcagaatacgctccaccaccatggcctggccctgcgttgtgttgttggtagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58855 - DNA, 1466 bp, Homo sapiens
caaaactacttaaaaaacactgctctttccatttccgtatcatttaaccaaacaccatcctgtgggttctgtcacttgatcctcatgctgatctgagaactcggcagagctgggtcactgccttccccaaggctaacctggtttctaagctggcacaagaccccaggtgatctatcatctaaccacagagcccttgctggacagagggtgaagacattatgtgtccctggctctgttcagggaagcagaggatagacctgaagaatttaattacttgtcatagataaagcctagagaaaaggtgagggcgcaaagtatctcctccaaattgggaagactcccccagggctcactcactaacgccagttctcctgagcctttaaagcctgggggtgagggagccctcctggtcaaccctctctaccctagcctcagggagcttcagggccccagcattgaaggaacagggtctgacctcatttgccaccgtagggatggggagactgaggcaggaggtgaatgggctcccagcttggagccctttcccctcaggacttggtttccctaccctagctcctccgcctgcagggacagaaagacatggtctggaaatggatgccacttctgctgcttctggtctgtgtagccaccatgtgcagtgcccaggacaggactgatctcctcaatgtctgtatggatccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 58856 - DNA, 401 bp, Homo sapiens
caaccatctgcgtggcaggagctatcacactggagcctcgcagtagccaaggagagacgccaatgagggaatcatttttccacttggtgaaatacatttttgccccgtgaaagcaagaggagggcctgtcttggataggtggagtggtcctaggtcctactagatggaaacctcaggactcggaagaggttcaccttcggagcgagtccccctaaggccagccgtaggatctgcattgagttcagcaagcggaggcgacttccccagggccacacagccatggagggctgcggctcagttgctgactgctccagctcaccctcacgtccatgaggtttctgctccaaaatgctattgctaagaaaaatgttccaaacacgacccattggctgaccacaggt

SEQ ID NO: 58857 - DNA, 494 bp, Homo sapiens
tgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacatggcagcaagctgaagtatgatgagtaaagaataggaatcaaagta

SEQ ID NO: 58858 - DNA, 410 bp, Homo sapiens
aaggactctgaagaactgtgaaggacttcatgcctctgtggttgggtggtcaaggtcatgagatactcagaggatctctgcaagcaactgcctgcaggaaagcagctgccttcttgggatttgctgattcattttgacttttttttttagtttttctctagcttcacttccagctgttgcagacacaagagatgaatgtctgtttgatcaagaggaaaggagtaaactttgttctctcgtattatttctctgcattagtgaatgtgcttgcttcctaaatcctcattagcaaagtatcttcttatgaagaaatctgttctgtccttgccactggatccatctctataaagactctagcaaaaagttctataggcacaatctaataatatgcaaaaataaatgcatcttaa

SEQ ID NO: 58859 - DNA, 4077 bp, Homo sapiens
tcctctgcgtcccgccccgggagtggctgcgaggctaggcgagccgggaaagggggcgccgcccagccccgagccccgcgccccgtgccccgagcccggagccccctgcccgcggcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaattgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58860 - DNA, 2512 bp, Homo sapiens
ttctcagtgccttctgtattcagcttttcatagcagaacttgtcggaccctgcaggaaggatggagaccggtggattcagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaattgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58861 - DNA, 3766 bp, Homo sapiens
tcctctgcgtcccgccccgggagtggctgcgaggctaggcgagccgggaaagggggcgccgcccagccccgagccccgcgccccgtgccccgagcccggagccccctgcccgcggcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatgggggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58862 - DNA, 2635 bp, Homo sapiens
tcctctgcgtcccgccccgggagtggctgcgaggctaggcgagccgggaaagggggcgccgcccagccccgagccccgcgccccgtgccccgagcccggagccccctgcccgcggcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtcttcatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58863 - DNA, 350 bp, Homo sapiens
ggacagattgcagtatccgggatccagttaggaaccttcacccccccaaggatgaaggacccaagggtttgtgtgattttggtttcaattcatggaatactgaattcgttgacactgttccaatgcaccagtataacattctaattgacttaagaggagacacataagaatatctgtttttgcctttaaagtatataatttatgttactgccaaattaaggattctgatatatcatatttttaaaatgtgtttgaattacttcttagtctagaactgagattgggaagaagtaaatatacacattttctttaatacagtattctttttctctttaaaccttattctcttt

SEQ ID NO: 58864 - DNA, 3986 bp, Homo sapiens
tcctctgcgtcccgccccgggagtggctgcgaggctaggcgagccgggaaagggggcgccgcccagccccgagccccgcgccccgtgccccgagcccggagccccctgcccgcggcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaattgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58865 - DNA, 1514 bp, Homo sapiens
ctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaattgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttgg

SEQ ID NO: 58866 - DNA, 239 bp, Homo sapiens
cttcactatcctccaaaccactacttaaaagagcaacatggaacttctatttctagtttgattactgtaaacatggaaattatgtataattttagacaatttagttaatatgactatttaaatgtatataaaattatcccttttggctgatggctgaatttttagaaaagatttccttaaaagttgaaagcttggtggtactagcagaggtctctctggatattttgaagtcgtaatgg

SEQ ID NO: 58867 - DNA, 373 bp, Homo sapiens
agttctcatgcatattcctatattctacaagcacactgattcctgcactatggccagccctgttcttgtggaattgaacctaagggcaagaagggcaagtcaacagttaggggtcatgtgatgagtgctgtaataggggatatatatggctcagaagtggcacagggtggtcagttcaattcagcaggggagagggctaagaagacttcacagagtgtcatatacttgagtgtggtttgtttatttgctatctattactgcctaagaaattattccaaaattttaacagagatttcaaaactccccatgccaaagctacggccatagcaattaaataagaatttctgggaataaactcagtcatcagctattt

SEQ ID NO: 58868 - DNA, 344 bp, Homo sapiens
acatctactaagttcaaggcctaggtgcataggattcatggagcttactgtctagtggggatctgacagggaaacagatgctctgatgcaatggtacataatcactggttcaaacttgcaccaagaaacagagaagactaatcctgtcatgcaacctccaaggaaggtacctttctttaacttcaagtcatctcaattgtaagagcattcattaaattcttttggtttggggcagtggaaagcaattctgactagtctagataaaacccaagaatttgttggaagactatggacacatctcacaaagtcagaagaaaaaatcagaatttaagaaggaacaaaaa

SEQ ID NO: 58869 - DNA, 2080 bp, Homo sapiens
ggaaatccagagggcaggggtggccggcacagcagacgtaccctccctcgctgcctgcctgcggcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgacggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcga

SEQ ID NO: 58870 - DNA, 248 bp, Homo sapiens
ctacacctttctacagattctttgttccaaatgatattttaacaaagcttcagcctacaacagtcaggtaatactgatgaagaggctagcttcactgggaaaacaagacaaaacattacgtcagaggaggaggaacaggtgagtaggacagggttggagggtcatcaaatggataataataaactagaaattttctttttttttttctaggaggcccctgtaagtatttctatcaagagtgttactga

SEQ ID NO: 58871 - DNA, 321 bp, Homo sapiens
tgaatatagggttggactaagagtattctaggttaaagaaactgtgagcttagagttggcaaaacctcaaatggttttgcctgtggacagtgagtgatataccttggcttggagaggctgtgccctgtgtactccagaatctggcagttagagaagctgaaggggtgggttactgccttgaatacaggctgagatatttatagtgtagtcattaacagttgagcactgatcaatactgttttaattgattaatctttttgttgctggttttttccttgatgaattcctcttccctggttcctttcatacagtagggtactc

SEQ ID NO: 58872 - DNA, 550 bp, Homo sapiens
gatgtaattgacatctatagatgactttattaaacagtagcaggttacatgttcttctcaaagtcatataaaacatttacccacatagaccacattctgggctataaaatacaacttaacaacatttaaaagaatgaaaataatgtaatgtctactctcagaccacaatgaaattaaactagatattaataacagaaaggtagttggaaaatcccaatatacttggagattgaacaatacaattttatttgtttattcttctcaagagaaaattaaaatattttaaactaaatgaaaatgaaagccaggcatggtggtgcactcctgtagtgctactcgagaggctgaggtgggaggatcacttgagcccaggagttcgaggttatagtaagttatgatcgcaccactgcactccagcctgagcatcagagtgatatcctgtctctaaaaaagaaaaaaaaattatatgaaaaacacaacttaccaaatttgtgggatgcagtaaaagcagtgcttacagggaaatttttgtagcattgaatgcgtatat

SEQ ID NO: 58873 - DNA, 585 bp, Homo sapiens
gctggggaggtagcacaatttggcagcattcggttaaatatcacgttgaaaaccaactcggctttttaagaaacacctctcccaggagaacattatatacacacacaccgcatcaatattcgccgtccacatccgttctgccacccctcccagccccaacagagctttctctggaatgaaactaacaaaattcaagatcctcagtttgcatctctgttctgatggattacatgtctgataatcaaccagaatgtcaagtcaagaacaatgattgagtatcaagtgcatgttcactgggcatcaagtgcatattcattgcatgcaagggaggcttgtctggaagaggcctaatgagcaagaaatgttcacctcagctctcacgggaaagctgtttatggccccagtaatcaaactgagaggccagataatccaaagatgaaaatggacctcccaaatgggtcaagctgaagaccagccagccactccctgaccttcagagcttgccacgttagtaatgtgtataataaagtgttgctatcttaacatcatgggactattcaggatactttaaaatgtagcagtgaa

SEQ ID NO: 58874 - DNA, 490 bp, Homo sapiens
ccatttccctgggctattgcaatggtcttccaataagttttctcatatctagtcttttttcttctattcaccctgccttattagtgccagagttatccttccaaaacacagatatggtcaggtcatagcattactgaaaacattttcaaacttttaaagatttctcatattctagaaactcaagagttgttttttctctacagtttccccataataaagtatgagttttttaccattgacattctggcatattctgactccttctggtttttttcaccattgttcaattggcagaagaagtaagagttcctttgttctgatcgtttgtcactgtatttacatgtgtgagttctgtatagtagtctgacttacgtaaccaattagttgtgtatgtattagcatattgtgagactttgaggtgatgtcttagtcatatttataatccattataatgatcagattttaataaatgctgcttgatttgaattga

SEQ ID NO: 58875 - DNA, 551 bp, Homo sapiens
ataaagcgggacaacacagaacttcccagttacaccaggcatcctggcccaaagtttcccaaatccaggcggctagaggcccactgcttcccaactaccagctgagggggtccgtcccgagaagggagaagaggccgaagaggaaacatgaacttctatttactcctagcgagcagcattctgtgtgccttgattgtcttctggaaatatcgccgctttcagagaaacactggcgaaatgtcatcaaattcaactgctcttgcactagtgagaccctcttcttctgggttaattaacagcaatacagacaacaatcttgcagtctacgacctctctcgggatattttaaataatttcccacactcaatagccaggcagaagcgaatattggtaaacctcagtatggtggaaaacaagctggttgaactggaacatactctacttagcaagggtttcagaggtgcatcacctcaccggaaatccacctaaaagcgtacaggatgtaatgccagtggtggaaatcattaaagacactttgagtagattcattt

SEQ ID NO: 58876 - DNA, 774 bp, Homo sapiens
acgttaaaaaaaaacccagagtgactgacggttggacagttatatactcagacaacttttcccacaagtggggcaagtctgcttgcttacctgtgcatatatgtgctgtgtgcatgcacatgatgttgctcatgctttggatatgaatgtatgtgctcctttgatcatgttgggttcttgacacaatgtcatttttcagcattaaaattcccatcacctagcagaagtgttccctttaagatccatttccgcttggcttgttgtgcataaacattccattgggattgattgcttgtgtcaaattaattttttcccttcccaggaacagtgtctgccatgtgcaaaatggggggaaatccccaggcctctagccaaatgcaaagctcagatataggggtaaagtcaggcttgggtcaagaattgttctagataagccacagagcctgcacctggatacttaatgctaacctttccaatatgctttgtgactgtttctaggcaacaggaaaaccctaggctgggtagagatggctgcatatgagaggcttgggttttttcagcatcagctgcagtaccacatcctcctctatatcttccttttcctgctttgtttaaaaggctgcagaggctgggtgttgtggctcccacctataatcccagtactttgggaggccaaggtgggaggatcacttgagcccgggagttcaagaccaacatgggcaacatagcaagaccccatcacttaaaaataaaaataaaaataaaaataaaaat

SEQ ID NO: 58877 - DNA, 487 bp, Homo sapiens
ttcagtcttcaggtatagcctaaggaggttgttttttttggtttgtttttaacttggaaggtagatcgcataaaatatccccactctatctagattttaccagccactcaccgcttatgtttgtaagcttagtgtttctggacagatggagtagagagaggaattacccaccatcttgcattcttctccctttcttctctgcattaagaatggcagtgtagggccaggcagcgtggctcatacctataatcctagcactttgggaggccaaggtggatggatcacttgagctcaggagttcaagaccagcctaagcaacatggcgaaaccctgtctctactaaaaaatttttttaaattaaaaaaaaaattagccaggcttgggggcacatgcctgtagtcccagatacttggggagctgatgcaggaagatcacttgcacccaggggttcaaggctacagtgagccatgtttgtgccattgcactc

SEQ ID NO: 58878 - DNA, 590 bp, Homo sapiens
atgaaagttctgagctaattaagaaaaaaatacataaggtttatggacatcaaaatgtcaccttgatggttgatatggcagatcttgaagaatgtcatttttgtctggaggcaatctagtcctgaccccgaaatccttcccctccagtgagtctcagccagcataggactgagacagacttccctagtaagactgccctcttgagactcacaatactgaaagagaacaatggctgctctctatggagctgctgactcccagtagaaagggaagaagcatgccctgtttctccttacaacaaaggtaagtcattccactcctcatgggggtcaggaagtaagtgaacagcaagagaagctacacagactgcacccactattggaaagacacaccagccatggagaagtgtcctctcttttctcgagttaggaggcaaaaattatttatgtgaggacctgaaatccatggctattcgacatcacatctatccattgcacaaatatttatttgagcagctaccatgtgccacgtgtatatttgctgagaatgtacactctgtgttcatgccccttgaagtctgtgggtcacac

SEQ ID NO: 58879 - DNA, 1309 bp, Homo sapiens
ttgactaaactaataaagttatttaattgaccaaatttttatatgtagtttccaggagtcttaactataaaccacagatttcttctttcccctctgtcacccaccaccttctggtatacttatacagcctacttgcattattgtaattttaaaccattttcagtttcagatgctttagaaatagaccagttgtttttgtggtatattgcaacaacgggaagattatattaccaataaaatgagattaaaaaattagagcttttcccttaattacataatgtttacaaacttggtgtagatgtgaccgtgttattcataataacaatcctttgtgtggcacagggcatcatgggaaaataatggagtcccagggggtagaaggcactcttttttgaccagtttctgtctccaataaagcaggactatagggatcgtgcctgaccctgaaaaagtgttggagacttttatcttttactctttataactgtgttatttcccactagcctggactggaaagcagccttggactgcattggaaccctgactgctcggtttacagtaccaaggccccagttttctgagaacccacctcatcctagatcaagtctgctttagagtgcattttagaatgcacagtgacctgctaaaacagaaaaaggatgtgaatggatagtgacatgtatggatggcaggacttggcacctgaccatggcatttggggcttctctttccctttgaaatgcaccattactttaaaaacggatctaatatcagttattgattcaccttacgtatggccaaaatgttataatgcatgttttgcaagtgctttatgcaaatgcttagagcaatcagtgtggttttcttacccctgtcaaccacctctggttttctttcctcttttactgttttcttataaaagagaccttgagtatgcttctctcttctgaattgtattttgggtcttttatctccatataactctttatagtttgtattttgctgagaactttgatgtctggaacctacagttgatccttttttgtggagagcaagaaaaatctggatgtgctggtcaaggaatcctctgagaattatggacactgggggaggaaagtgtatgtcagggaggagaactagaaggagaatgtattattcacaggaagcctaagatgaaaaatattggcaaaagagattgggaaataggtagttatggaattcctaataactagggaatctgacctaagacctttgttttttcatgagtgtagtggaatttaaactgtgcatgttatacaaaaaaaaaaaa

SEQ ID NO: 58880 - DNA, 348 bp, Homo sapiens
cgagatgagagggaattcacacttgcaaagaaatagaagtagaatagatagcaattcacaattcattgtgtcccaaacttaagtggaaataaaagaaaaatggtacctatagcatttaacattatgtcactacatcttccatgtatacaaaatagacagctaattgtagaatgtggaccattttttactaatctgttatttaacagttgattattgagcaaacttatgtatcaggcatttaaaaattctaaagcacttggtgttaaacattgaaaaagatgttgtcccatccttcaaggagcttaattatgcaatcatcaatattttcaaaataaagccaattgtttt

SEQ ID NO: 58881 - DNA, 159 bp, Homo sapiens
gtgaaattaaatatagcattttatttggaacaagccatcctaactcaatttccctccccagcattgccacagagagaccttccatttggcagctgaaagatgcgctgagctctaggctggacgtaggacttctttccacgctcttggtaatgcatctgc

SEQ ID NO: 58882 - DNA, 522 bp, Homo sapiens
gctaatcccattcacaacggtcctaccatcatgacctcattacctcccaaagaccacacctccaaataccaccacattgccattaagcttcaacatatgaatttaagggggaaacaaacatccagtccattgcagattgttctgataatatgtgtgcccagggcattgcccccacagcaaagagcgacattggaaggcaaaccaatgtcaggtttcctaatgtgcacggagtcatccctggaagagtgagtccggtgatcttaccagctaattgcattgagctaccccaccttggggatctacctgccaaggagaacagaacaccactggctttgatacccatctctcaacaatgatggaagaatgctggaaatttacctgctctggtagctctctctaagttcatcttccttgtatggactttctttttttattgctctcaaatacttgtattattaaatatctcatttaaaatttctttaaaatacattaaaagtacatttaaagagtacattttaagag

SEQ ID NO: 58883 - DNA, 389 bp, Homo sapiens
cattggcaaccaagcagctgcccaaccagctcattatgacctaaaaagaaaaaaggagctttgcaaggaagctttgcaagcacgccagctcctgaatttcatgagcagtgggcagctgaatggtgagttctcgcctgagcttggcttgaaatgcacgtaagaatgaaaggggcctccagcacagtccacctcttgccactctgttatagtgctgtgccctgggatattcaggaaagttacgctgttccatcatctcctgcagccgagaaacacaattgattttcctggcctcatttctgttataaagaacaatttcccccagggatccccagagaactaaaatggagaaaatgtcattcatattttaccatgcaagccaaagcctaatt

SEQ ID NO: 58884 - DNA, 412 bp, Homo sapiens
gccttgagtttcttccaataaagcactgttacctgaaaaatgcccatcagaacagaattgctccacctttgaatggttctgtctataggaaagtcttttctaataggagcccaagtctcttttcctgcagctttcacacactggggccactctgaacaaatttagtggtttgacaggaatgattaggggtggggatgggactcagaaacctctgcagggtgcctagtaagtgctagacatcttgcatgcattaagtcgtaaaccagaaaactccagagagacctttgctgtggatattactgtcccatgttgcggatgaggaaaggggctctgggaagtctgcaggttgcccaggacacaggtccacccagctctcatctagcctgtcttctggtttcccttcagatggctg

SEQ ID NO: 58885 - DNA, 291 bp, Homo sapiens
tacctactagggtgacagtttgacaagggttaaaggtacactcccttattatcctcattcatcttctctgccttgcatactctgcattctattggtctgggggaaatgcctggagctgagacagctcagtggtagaaaaagtccgtttcccgctgtggtgttctgcggcagtgccagcctctctgcgtggcctagcactgccctgcccttcttagcattaggccctcattgtgggtagtgctgacaaaattgttcacaggcaaagcaaagcaaagcaagctcttaagcaga

SEQ ID NO: 58886 - DNA, 2198 bp, Homo sapiens
  misc_feature (513)..(513): n is a, c, g, or t
  misc_feature (808)..(808): n is a, c, g, or t
gtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaangttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctctctgagcttcatccaatttgcaacaaatctattttaaggcaagaagttgattatatgactcagnctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtccttgcctttgaagggtatgtcacaaggagctgacagtgcttctacacatttcatctaatttaatattcctggcatacctttaaggtaaattggtcaggaactattaattccatgtgatacattaggaagctgaattattagtaacaacaataataattaaagaatgcaatactgta

SEQ ID NO: 58887 - DNA, 2384 bp, Homo sapiens
  misc_feature (513)..(513): n is a, c, g, or t
  misc_feature (994)..(994): n is a, c, g, or t
gtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaangttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcagnctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtccttgcctttgaagggtatgtcacaaggagctgacagtgcttctacacatttcatctaatttaatattcctggcatacctttaaggtaaattggtcaggaactattaattccatgtgatacattaggaagctgaattattagtaacaacaataataattaaagaatgcaatactgta

SEQ ID NO: 58888 - DNA, 353 bp, Homo sapiens
caggggatgattggagggaggttctttttggaggccaaagattgaggctcctggtcaccccctgatgatactaaagaaccctctttctagggaatacaagaaataatgtgggccccaacatcagaatgagaaaaatccagtctggccagaaactctcaactcgagattcatttccgatgccttctctagttgaaaaattaaatctgggccgggcgcggtggctcacacctgtaatcccagcactttgggaggctgaggcgggtggatcatgtggtcaagatatcgagaccatcgtggccaacatagtgaaaccccatctctacaaaaaatacaaaaattagctgggcatggtg

SEQ ID NO: 58889 - DNA, 913 bp, Homo sapiens
  misc_feature (711)..(711): n is a, c, g, or t
ctggtcattgtcggcctctgtctctggctgccctcggcctccaaggaacctgacaaccatgttcaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctatgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctnggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccact

SEQ ID NO: 58890 - DNA, 1147 bp, Homo sapiens
  misc_feature (945)..(945): n is a, c, g, or t
acctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgagtcaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctnggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccact

SEQ ID NO: 58891 - DNA, 1197 bp, Homo sapiens
  misc_feature (873)..(873): n is a, c, g, or t
  misc_feature (1197)..(1197): n is a, c, g, or t
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgactgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagtgncaagcaccggcagctgagcgagcccccgcaagactgggcgtcacccaagccgtgaaaaacgatagcgcggcgacaccgggaactgagacgacagccagcacaagactagaaccaccagccgaggaagcaccaccacacaccgacacgtgagccgccgacaaacgacaggcccactaaacagcgagaaccatagagcggacaaccgtccaacggcataccacgaggacacaaaccacacgacacacggataaaagcacgtttgcgtgccccactaagaagcacaccaacacgacggtcggcgacaacgcaccaccccaacagagn

SEQ ID NO: 58892 - DNA, 2730 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58893 - DNA, 1842 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58894 - DNA, 1213 bp, Homo sapiens
gaagacagctcagaggaggtggacagcaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58895 - DNA, 2327 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggacatcaaggacgccctgcgcaggtacgaacccagcctctcctggagggggggcaggagggagtggggtgggacccagctgttggccatggcgacaacacctgggttgtcccctctagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatgcttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctctttaaa

SEQ ID NO: 58896 - DNA, 265 bp, Homo sapiens
gtgctcctgggcgggggtggcgtgcaggggcgtcggggagccggggactggggaggcctgggcgggtgggaggtttgggggactgctccgggagtaatctgtctctgtctagggcggggagctcaggatgcagcctgctgtgggcctgtgaggggggtgtcgcgcagggtggctgtgggggctcatgacacagcctgtttcaaccaggccccttgaggctgggaccatggccgccaatgagaccctgctctcgggggtgaggggc

SEQ ID NO: 58897 - DNA, 1802 bp, Homo sapiens
ggcacgaggcgagactctggcatgctaactagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58898 - DNA, 2494 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagctgggttgtcccctctagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58899 - DNA, 1557 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgactgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtcatcctgct

SEQ ID NO: 58900 - DNA, 2559 bp, Homo sapiens
ttcctgtttccgcctcggctcctcttcctgcgggaatccgggatccctacgtcccgcgtccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatgcttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctctttaaa

SEQ ID NO: 58901 - DNA, 1067 bp, Homo sapiens
tcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggagatcttattctaccatgggacataaggagcatccactgcacaaacccttaatgaacactgtcttttcatggattcaaggaattccagttttatctattaagattttatcttaatgatgagtagccaaggtctaacatagggcctctcctcaaggagagatggagggatacaattcttggttcagtgggaaacagaaccctaaaacatccatttgattcaaggtgctggtccaacagagtttttaaactactcacttctttatttcatcctttcgactgtacttgattaccagtgaagtaagatgggtcaggttacgacttacaacttttgttctattccccagactcctcattattcagtacatttcccaataatctctttttctcatctcttgctttataaattgttacgttggtggagaagcaaaacatttggtgagttgtattctggttttccggagttggatttttttatattatatactttcatgtcaaacttctattttacttatttatttatttttttaaaatattttttgtagagatgaggttttgccacattgcccaggttggtctccaactcctggatcaagcaatccatccgccttgacctcccagagtgctgggtttacaggcat

SEQ ID NO: 58902 - DNA, 1943 bp, Homo sapiens
tttttggctttttctggccgggcgtagtggcttatgcctgtgatcccaacgctttgggaggccgaggagaggcgactgcttgaggccaggagtttgagaccatcctagcaccaccacgcccagctaattttttgtatttctagtagagacagggtttcgccatgttggcaaggatggtctcgatttcttgacttcgtgatccgcccgccttggcctcccaaggtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58903 - DNA, 1840 bp, Homo sapiens
tttttggctttttctggccgggcgtagtggcttatgcctgtgatcccaacgctttgggaggccgaggagaggcgactgcttgaggccaggagtttgagaccatcctagcaccaccacgcccagctaattttttgtatttctagtagagacagggtttcgccatgttggcaaggatggtctcgatttcttgacttcgtgatccgcccgccttggcctcccaaggtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaaaaaaaaatctgttgggctgggtgagccaccgtgcccagtgcccccaccttttttttttttttgaggcagagtctcactccatcaccaaggctagagtgcagaggttgcagtgagctgagatcgcaccattgcac

SEQ ID NO: 58904 - DNA, 1771 bp, Homo sapiens
tttttggctttttctggccgggcgtagtggcttatgcctgtgatcccaacgtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58905 - DNA, 1997 bp, Homo sapiens
tttttggctttttctggccgggcgtagtggcttatgcctgtgatcccaacgctttgggaggccgaggagaggcgactgcttgaggccaggagtttgagaccatcctagcaagaccttgtctctaaaaaataaaagaattagcagggcatggtggtgcacacgcaccaccacgcccagctaattttttgtatttctagtagagacagggtttcgccatgttggcaaggatggtctcgatttcttgacttcgtgatccgcccgccttggcctcccaaggtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58906 - DNA, 1950 bp, Homo sapiens
tgagatggagtcttgctttgtcaccagctggagtgcagtggcatgatctcggctcactgcaacctccacactccctggttcgagcgattctcctgcctcagcctccctgagtaggcaccaccacgcccagctaattttttgtatttctagtagagacagggtttcgccatgttggcaaggatggtctcgatttcttgacttcgtgatccgcccgccttggcctcccaaggtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58907 - DNA, 1808 bp, Homo sapiens
gaaatgttaaaataggccaatatgagtcaaagtgcaaattttttggtgagtaggttgacaaaaaaaaaaaaaaatccaggaaaaaaagtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58908 - DNA, 1834 bp, Homo sapiens
tgagatggagtcttgctttgtcaccagctggagtgcagtggcatgatctcggctcactgcaacctccacactccctggttcgagcgattctcctgcctcagcctccctgagtagtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58909 - DNA, 1878 bp, Homo sapiens
agacaggggtctgcagtcccagctactcagaaggctaaggcaggaagatcgcttgagcccaagagtttgaggctgtagtatgctgtgagtgcgcctatgagtgccaactgggcaacacagtgagacccctgtctaaaaaaaaaaaaaaaaatctgttgtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58910 - DNA, 1350 bp, Homo sapiens
gcccagcctgagactactttttgatggagcccactcaaggggatgaggaggtttaagccacaagtggctggctaaataaaagcttagtcagagctgggcacggtggctcacacctgtagtcccagctacttgggaggctgaggcaggagaattgcttgaacctgggaggcagaggttgcagtgagctgagatcgcgccattgcactccagcctgggtgacgagcgaaactccatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58911 - DNA, 552 bp, Homo sapiens
ccaagttagagaccactgtatctgcttaagatttctttggccccactcggaaaaaggcaggactcataactatgctgcagttccataatccaacccccattttgatatttcagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggagatcttattctaccatgggacataaggagcatccactgcacaaacccttaatgaacactgtcttttcatggattcaaggaattccagttttatctattaagattttatcttaatgatgagtagccaaggtctaacatagggcctctcctcaaggagagatggagggatacaattcttggttcagtgggaaacagaaccctaaaacatccatttgattcaaggtgctggtccaacagagtttttaaactactcact

SEQ ID NO: 58912 - DNA, 1949 bp, Homo sapiens
tcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagttggaaagagatgtggctgcaagattattggcaaggtctggaccagggggaagctctcactgccatgatccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcatcccaaaaaaaaaaaaaaaaaaaaagcttagtcagatttggggatgcagccaaacccttctgttgctgtggtttgaacatacagtctaatgagcagggagaccattagctctttctggggcagtgggacaggaaagaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcactccagaaactaaaaaaaaaaaaaaaaaaaaccttcaaaaatatatctaagccagatgtgatggcatgggtctgcagtcccagctactcagaaggctaaggcaggaagatcgcttgagcccaagagtttgaggctgtagtatgctgtgagtgcgcctatgagtgccaactgggcaacacagtgagacctctgtctaaaaaaaaagccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcaaaactccatttc

SEQ ID NO: 58913 - DNA, 412 bp, Homo sapiens
gaaactcctgagctcaggcaaatcacccacctcggcctcccaaagtgctgggattacaggcgtgagccactgtagccagcccagtttttaaaaatcacacaaattatcatattgcacagaaaagcaatgttgaaaatcctgtgaatactcttaataaatccttacaaaatcagttgagcaatttttaccacacatctttcctttctatactgcttatcacttccagaaactttagttaattacaaacatttccatttttttaagtccagacttgcagattttaatttgcaatataaacaaattggtaatatagagcccaattttactggcaggaataggatttttttttttttttttcaagacagggtctcgctctgtcacccaggctgaagtgcagtggtgtgatcagggc

SEQ ID NO: 58914 - DNA, 365 bp, Homo sapiens
cccttcctcaaaagataaaaatctctggcagaagaaatagttacctgctgccatccatcagtactgcaattaccatgactctaagtgaccttcttgcccaatgtttaatgcacaatggaccgtgcccagggagacctgggcatttctgttgctttgttctacaatgatcccttctgttctagcagcgtgagctcactgatggtcatactctctgaggactgtacgcattttcaccctatatccacctgtaccagaaaacatggacataatttaaagtttatttctacttaatagagtgatattccaacctgtgtggaaataaccatttgtcactctttaaagaatggtatttaacatttattata

SEQ ID NO: 58915 - DNA, 459 bp, Homo sapiens
aatctcagccccttggcggaaatcaatccagtatgactatctaaagtaagagaaagcagcaaggctgtgttagagagagccatgagaagatgccaaaaatgtggacctcagctttgccactggctcacattgcaaatttgggcacattatctcacgatttggggtctcacactcccacttgggatataaaaggatcgggctgataattttcaagggttctgctattctaagattctgtgactcaagggaaataaaaagtgatgagagaggaaaccacatcaatagcagtatgggttcccaatgtcaaggtgatcagagctgtgagtcccagtaacagccttcaggccctctactctgcattcttagcactttcagtatcatctgataatgtctattcattgaatgcctctatgtgccaggcaagacttgcctaaaatagtgaattccttgcttagaagc

SEQ ID NO: 58916 - DNA, 309 bp, Homo sapiens
tgtgttactgaccatgtttttgagagtagtgcccctaaccactttgtctccacttgcatagtgtagtgatttttaggactctgtatgtcatattataacagaactgactgtatatggctattttatcccataatcaagccaattcttccagaatattaccatcagtattaccacatacatccttccaaatcttatttcaaagaataaatatatagtcactcatggtttttaagaaaacccaaaactactcaaccaaaaccttgaggaagatttttccagggttttctaccttaattattcataatgatt

SEQ ID NO: 58917 - DNA, 1077 bp, Homo sapiens
gcctgcagaggcctgaacgtttcccaggattgtcttctaattctcaggtccggctttaaaacaaaacctaaactaaaactaaaatgctttctgcaaagaataatacaccaacataaagtccgggtatcctaagcatgtggtgtgtatggtgtctgaaattgaatatgctgtgaaactgcctgtgtcgaaatgcagtgtttcccaagacctggaggctctctccagctgctgattgtgatcacctctcccgatcaccgctgagccctgcaggtcaccttctcctgacctattacaccactgattgcttatgctgggcacaattttatacccttgctgttgttcagtctaatcatccctataaccctatcggatcattcccatatgacagaggagaaaacctggggacacaggggctgtgtcctggccaaggccttgcttgcagcaaaaggcagagctggggtctagccaggagccccagcacagtcctgttcttcccccactaaactgagctgtgaaatagatcatggcagtttggaaaacgggctaactgtatgctgagggaggtggtgacggatacctacttcttttcatgggaaggtgaggtgtctccctgcccccctcaggtctagcctctctctgtagctcagaaccttgggaaagtgggaggctcagaggaggaaagagatttacttgcccaagggccgcagctgctaagtggcaggtaagggactgttattctcctgtccctttcacagaggacaggaggaaagtgaggacaggtggtgtacatgcatcttttctgcagcaggcccagatcagctttgcacatggtgctgacctcaaattcagccctagaggggcctgtctctgccctgagtgagtattgaagtgcaggcttcttcccctttgttctgtccatttccaaaaatgtgaacacacacctccaacatgtttctgtgtatattattgtgtgcatagatactaccattgtgaaatattatgcagattaataatgcactatgccattgaaaatttcaaaagaaatgtgtaataaacatttaaaattaaaaaaaaagt

SEQ ID NO: 58918 - DNA, 594 bp, Homo sapiens
gcctgcagaggcctgaacgtttcccaggattgtcttctaattctcaggtccggctttaaaacaaaacctaaactaaaactaaaatgctttctgcaaagaataatacaccaacataaagtccgggtatcctaagcatgtggtgtgtatggtgtctgaaattgaatatgctgtgaaactgcctgtgtcgaaatgcagtgtttcccaagacctggaggctctctccactgctaagtggcaggtaagggactgttattctcctgtccctttcacagaggacaggaggaaagtgaggacaggtggtgtacatgcatcttttctgcagcaggcccagatcagctttgcacatggtgctgacctcaaattcagccctagaggggcctgtctctgccctgagtgagtattgaagtgcaggcttcttcccctttgttctgtccatttccaaaaatgtgaacacacacctccaacatgtttctgtgtatattattgtgtgcatagatactaccattgtgaaatattatgcagattaataatgcactatgccattgaaaatttcaaaagaaatgtgtaataaacatttaaaattaaaaaaaaagt

SEQ ID NO: 58919 - DNA, 849 bp, Homo sapiens
gaggatttacaccctggttctcaggccttcaggctctaactggagctacactatcaactttcctgggcctccagattgcagatggtggatcacggtactttttagcctccatcataatatgagaaaaaagaggcacagtgaagctaaatatattggctaaagatcacaaagctaagttgaaatttttcaagatgaaaagttgctaaagaaagagaaagggaagcggtttgctccagtattcctctttccaccttcccactgactgggaagcggcggttagcagagccacagtcttggattagagataagagggacatgttgaggaaggtggagtctcccccacagccctggaccaggctccagtgccaacaaaagccaagaagaacctctggagcaatcagtctctctgctgagggagtgcattttgcttccagcacagtgctcaactcacacagttcccatggaaacccaggggctacagaggtgtctagaccctgtttggcactctaaccagaagtattcccagagactacaagcacactgcacaccttggctcagtttcaaactggagacaggcagagaaagaaagatcttcctcccctactttcccggggaggtcttgaggagacttcctttttgttagttgtttccaaattgtccctatctgagtggttctcaaacagtgggtcttcgcgtggtcatgaagggcctgcaagaagataagggcaccaagcgtggcctgtggctgagataaatgaagcatctctcatatatgtgttatgatttttcaagtaaatgaggttgctattgggcttaattaaaataaaaactaatttaagagcaatgcta

SEQ ID NO: 58920 - DNA, 1342 bp, Homo sapiens
ggctggtctcgaactctggggctcaggcgatctgcctgccttggtctcccaaagtgttgagattacaggcgtgagcttgtgccctgctgtcaggaatgtttttaagttagccttagacatcatatactttcacttacataggttgagtatcttttatctgaaatgcttgggaccataaatgttttggatttcagatttatttttggattttggaatatttgcatggtacttaccagttgagcatcctaatctgaaaatatgaaatctgaaatgttccaatgatatttcctttgagctcaaacagttttgatcttggaggattttagatttttggattagggatactcaacctgtaatactcctgtatacatcttgtaactgctaagcagatttcttttaaataatcaccatattatacctaacaaatttagcagttttgttactatcatccaatacccaatctgtattcagatgttcttgatcatctcagaagtgtctttttacagttggtttgtttgaataaggattcaaatgaagtccatgcattgcctttggctgttaggtatctcttgtaataatctcctatttattactttcattctgttgatttgttgaagaaacaggcatttgagctgtaagctattctttagaagaaattgaactcctttctaactgctttcttccctttgtgtgtgtatgtgtgtgtgtgtgtgtgtgtgtatttaaaacaatctatctttacccttggtggtaaccaatctttacaactgaaataaatagtaaatagtttcttgccatctgttcacccacatcactgttgtttcatacctccttttcacaaatcctagcatagggtttctcactggataggcattatcttgtttattgaatgaagaaggaaacagacacaaggtggtttgtccacgtaagtgggatttagttatatgggaatgtttatggaaggcaggctattactttgtttctctttagtttggatcttttttgtctcatagggagatgcaagatacatgtgtatttatcttatttccatgtactagaaaataagatcccaaagggtagggatctttctgttgcctttgccctgtgatgtttctcaaagacctagaatagtgcttggcacagagtaggtgcccagtaaatgtgttgaattgggtgacccaataaaaataaatgccataaagaaaatgtcccaggctgggcatggtggcttaggcatgtaaccctagtgctttggaaggccaaggcaggaggatcacttgagcttaggagtttgaaactagcctgggcaacatagtgagaccttgtctctacaaaaaaattt

SEQ ID NO: 58921 - DNA, 546 bp, Homo sapiens
ctttgaagagcctgccagcagtatctgagaatggcctctggaccccttctcagggtgttaaatgctgtgttatagtacatgccgtagtagagaagatctctcattcagcttaatattctgtccccctggatccagcaccttgaggtcctctcccaggtgcattccccagctctgtcagaactcgttagacacatcccgtagccggtgtcagccatggaggaggacagggcagattctggggagagcaagcagtatctcatgagattcccatttcatttgaggcctatgtgttatattcaagcaaggagtgtgtggggggcttctgtcgtacaacaaaaggggataggtcacttctgtaggcacagtgttaagaagaatttgaggactaaggttctcaaaggcatttacccagctatccccatcccaaatctcagaatcctgttccttccctgttagggcccagaccctgccacgggaactttatcaatcaaggccaataaagagaagttatggggagactgatttaggatcaatattaaaaaaaaa

SEQ ID NO: 58922 - DNA, 4768 bp, Homo sapiens
catgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctcccatgtagaggtgggagaggtggttgatggggcagtggaagttagataccagcgatgtatatggtaggacattttcctgggtcactttgacagtaccttgggaaattgtcaatccttgcagagggcctaggctgggcacaagggagaaagcgaacagttgactaagaattgaggggagggtctggagcgctactgccctcctgtcattgctgtgggtgggagaggctaagacttcaggtttgactggaggcctaggagagaagagtgtccttagggtttcaagaattttaatgcctagcagctgagtaacaggcattagttctgatagatagtgaaggggagaaagtgccacctgttgtgagatcacctctccagggcagcagctgccttgttatcaccagcaaccttagccctggtcagtaatatttctgctaagaaaggttttgaagcatggcctccaatgactttcataagcccttggaggcaggactgtgtctcatccatctttgtatcttcagtaccatcttgtaaggtgccttgtacatagtaggtgcttaatgaacaaatgttgcttgaatttagctgtcgtccagccccacagagttatgctccatttgccaccatgtgatatttttgagaaacaatagtgatttggatgccagctctatgtgactttgggcaagactctccatctatcttgtcttcatttcatctgtaaaatgaagtgagtagattcaatgctccctaaggtcccttccagctccaatacttgacaagcttgtgattctaaatcgtttccgttgcctctgaacatgggtgagtaatgcctccactgcagctgtttctctccaggaggctttgttcagaggaggtctgactattgcacagccagttttttcttcctcttcagcagttctttactgtcttcagaatagttctggataagcggccttttctgaaaggatatttaaaaatatatactatttaggctgggcccagtggctcatgcctgtaatcccagcactttgggaggtgaaggtgggtggatcacctgaggtcaggagttcaagaccagcctggccaacatggtgaaaccccgtctctactaaaaatacagaaattagctgggccctgtggcaagagcctgttatcccagctactggggaggctgaggcaggaaaatcgcttgaacccaggaggtggaggttgtagtgagccgagatcacaccactgcactccagcctgggtgacaagaacgaaactccatctcaaaaaataaaataaaatatatactatcttgctcctcagaaccagtggggaagaagagggaaggcaaagaaagaaactgagcatagtaaacacagcatttttttgtaggctcttatttaaaatgtgtgtgtgtgtgtgtatgtgtgtgtttctgagtaagtattgactgggaaaaagagagaagtcaatcaaaagtatactgtgcaattgagagaggctggcccaagatttaaaacttcctgtgggtaatctaactgtgagtagataggaatcggccatatgacgaaatgagatcaataggaaatgtgctttttgaggaaattttattttagtaccaaatgttgccagtgacaatcttcagttaagaagtaagttattctgacctaaaattcttatctctgccactttggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaagtaaagactg

SEQ ID NO: 58923 - DNA, 980 bp, Homo sapiens
agggggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagat

SEQ ID NO: 58924 - DNA, 746 bp, Homo sapiens
agggggaagtctggaggacgctgaggggcggaggcgggagaggcgagctcgcgatgagtggtctcggcaggctcttcgggaagggtgagccagggtgggactggccagccaggaggcgctggctggtgcaggggaagaggagaccccggcgagattcggccggaccgctgcgccgggcaggggaagagaatcaggagacaggctgactggaaaaccccggcggccgatggcggagcaaggctcatcgccggtgccaaaaggcacaccatgtcggggcgccttgttcccgtccgccgtcctcccccactctcagagggaagaactcaagatctgggaggggacttgagttgagggcgtggcgatcgtgctgactcccactgttcaggcttgaagacgagtttcctgctgtcttcagccattttcaaaaccttgttctataatactttgtgctgggcaagagggatctaaggtgaagaagaaagactgccttcttagcccggcgcgggggctcacgcctgtactcgcaacactttgggaggccgacgtgggtggatcatgaggtcaggagtttgagatcagcctggccaatatggtgaaaccccgtctctactaaaaatataaaaattggccgggcgcggtggctcacgcctgtaatcccagcactttgggaggccgaggtgggtggatcacctgaggtcaagagttcgagaccagcctggacaacatggtgaaaccttgtctctact

SEQ ID NO: 58925 - DNA, 1366 bp, Homo sapiens
aacatggagaaagcctgtctgtactaaaaacacaaaaaattagccaggcatggtggcacatgcctgtgatcccagctatttgggaggctgaggcaggagaattgcttgaacccaggaggcggaggttgaggtgagctgagatcacgccattgcgttccagcctgggcaacaagactgaaactctgcctaaagaaaaaaaaagaaaggcagctaggaatagtaaaaagaatatgggttttagaactcatactgccacatcttgattcctgcacaatctcttattagttgtgatttttaacatctttgtggttgttttcacatttttaaagtgaagagatagcacgttcattgtagagatttggggattagcaataacacagtcaggtctctagcacatactatgtattcaatgattggtggctaatatttttccttcacaaaatttgggcctactccactggactcctcagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagat

SEQ ID NO: 58926 - DNA, 926 bp, Homo sapiens
agggggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagat

SEQ ID NO: 58927 - DNA, 479 bp, Homo sapiens
  misc_feature (18)..(18): n is a, c, g, or t
cgatgagctcggcccgantatacaccgatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagat

SEQ ID NO: 58928 - DNA, 1018 bp, Homo sapiens
agggggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaa

SEQ ID NO: 58929 - DNA, 1430 bp, Homo sapiens
agggggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggtatgcagggttgttctgttgtcttgaggacttaagagggtgggagagatatggggaaagattattcctcatccatcctgcctcaaaggagccacacagaaagggctgctgctgcagttgtgcaggttgttgactgcatataggcacccacctagcctgtgcttcactcaacaagccgtgtaccctggtttagggctgcaaatggcaggagcaagaggcaccatttttctaatttgcacaaaggtgctgtgggattgaacagcagcctagcaagcagaaggaccatacctttaggttttttgctggggagacagaattcagcaggctctgaatgtcatagcaggggatggttggagttgctgagaccttactgcttctcctttcttttctctgggtatctttgtcctcaaagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaa

SEQ ID NO: 58930 - DNA, 2305 bp, Homo sapiens
ttagtaatgttaatgctttgtctatttgttatttttaccactgttgaacagcaaactgttgaggctagggttgattattgataatttttatgtgtttagtaataaccacagcatcatacgtacaactgctttaataaatccaagttaaggactttgaggagagcatgtagcaagtattcattttaacaaatcatcacagacagtttccctgttcaaagctccaccaaaaagcaagcatgcagcaaaggcatagactgtatttagagatgtggtttcatttattcttgaagtcctataaccttgcattatttaaacacaaaatcccacctaacatttgccaaatccaagttaatctcaaaaacctccgaggacattgagcacaagcagattactgtaagggcactggtggcagattgtggtggagagagggctgagtgacccagagcaaagcctgcccgggttactcgctgccacttcaggagagggattgtatcagctctcattaccttttgtcatgaggcagttcataaattaaatatgatatcatgcattatctcaaaatatttctatattaattagataattcacgatgtaaaacgtgttcatgcagaagcaaaggcggatgtaatagtcaagtatcagggaaaaacccctttaggatacccagacattaaaaatgtaaaaagtagcttataagaaatgtggattatcagatttttactatatataggttgtgtttaatagtaatttctgacacctgcacatagatgaagaaaaggcagttgttaccacttttcaccattcaaaaaatgggcttgtctcttagagtattggttaatgctttgcttatttgttaatgaagacagcattttaattttaaagcttccttttgtaggactgatggcacgggcagaatcacatttaagaaaaatggtttggaacactttttaataaaaaattgtaaaatcagtttccagtgtggtcaaaattagaatgtaaaggaaagcatttttaagaaaatacagaagcccaaatcaagggagagtaatataaaaggaaatattttaaattaagaaaaggaggtgttatagtttattacatcatgaattatgctttctgtacttacgctcttagtgaaggagataacattgaagtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcac

SEQ ID NO: 58931 - DNA, 881 bp, Homo sapiens
ggggactcggtggcgtgtggtgggcgtgctctgtcgctaaaaaaaaaatatattaccagatacaccagggaggcgcggggtgtgctcgtcgttggtgtgcgccgcaccccgcggggctgtattggggactatatgctgggggcgcgctgtagtgcgctctctgtgggagctgctgctcccgagggggcttacgctaatcccccggctagcacgttagcttttggttgtatggaagcgtcaagccggctcggggaaaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcac

SEQ ID NO: 58932 - DNA, 263 bp, Homo sapiens
ggttgcagtgagccgagattgtgccactgcactccaacctgggcaatagagccggactccatctacaaaaaaaaaaaagacttggataagagtctgtcaacccaagagcccaagagcagtggtgctgctggactctattcttcatggggctgtacagcggagtgcaaacggatgcagatatccaaactacggaaggcttggtgggccttccaagtgctggcagcaaatcctgacagtcagtgaatagcgactctgcccaaaaa

SEQ ID NO: 58933 - DNA, 488 bp, Homo sapiens
ctctgagtgggtcaaatggggactggaaaaattccacccactagctcagctaatgggtaaaaatgctggacatttatctggagctgcagggggtaaagtgtcatccttgggaaattcaaagctggcctgtacctgctgagagcaccagggatatggtcacattgcaagcctgttgccagcaccccaggcagagtcatcaacaattactttggaggagggccacttccaccttccagggcataggtgacccctgtggaaaacaagtacccctggaacatcctagaagtggaggtggaccataaactagccactggaatgagaatgcagtaaaacagcttgcctcagagtggtcttccctggaacacacagcttctgttaagcattcatgattctgacgggccagtcatcccttcattgactttgtccagcagctccaccattacagtctcattttagaaaataaagacacttggaaacaaaaaaaaaaa

SEQ ID NO: 58934 - DNA, 318 bp, Homo sapiens
tgctatcacttgaagtttaatgagttctacataggtagtatgataaataggtagaaggtggacagatctgctggctttatggggcaaaaccaactcccttgaaaattagtctgccacagcaatcccgtttctatctcctcactcttcctatttcccaattcttacctttcatttatgctagctgaatttagaagtaattaagaggaaatagtgagagacttcaggctgcctcccccaacccctctcatctctctctttctcatagacacacacacatacctatgtgtgcacatgtaaatatctccccacaaaatatat

SEQ ID NO: 58935 - DNA, 332 bp, Homo sapiens
gtgggctgggcctgggactcatgaccctgcagcatctgaccggctgacccagtgtcctagaaagaaccattcttgtcccaggtgcatgtaatttattaatggatggaacatatcaataaatagaaatatttggaagtaatcttactgaagtgctgttctccatacagaagcctctagcaggaagaggatttacttgcaaagaaatatatttggtttttttgtttgtttgtttgttttgtttttggagttggagtttcgctgtgttgcccaggctggagtaagtggtgcggtctcagctcactacaatctgcacctcccaggttcaagggatt

SEQ ID NO: 58936 - DNA, 386 bp, Homo sapiens
ctaactaagtaagggttgccagataaagtacagaaggcccagttaaacttgaaatgcatatgaacaagaaatatattttagtatgaatatgtctcatgcaatatttgggacataattatgctaaagaaagtattcacagtttttccaacattcaaattggaatgagtgtcctgtatttttatttgctaaaatgggcaaccctaagctggtatctctacagttacatacacttaccaaccccacccattcatactggtccaagttacaccccaaaagagggcagaaacagaatctgaacaagctcaagtttggagggcaaaaatgtttcattctgccttctggattgctgtatgaagacttttgttgtgaaagatatgaatagaacc

SEQ ID NO: 58937 - DNA, 400 bp, Homo sapiens
ggtttgggcgttttcaggcggcctcctgagaaatgtttgcaattgtaaggcgtctctctcatccaggtttacccagattcgcaaactatggcgacaaacaaccatagcagaagcatgtccggattatttcacatatatcacaaaatcctgcaaaggggatggctaatccagagaataagaagctcagaaaactactggaataagagtgtaagagagaatccatgattagagggccaagaaagaccatgggagctgaaaggcattgtgtggccctgattccaatcagaagtccggtaacaagtagcttccgttcccaaagcttaatattaactgtctcaaataattttgcacctgttcacttttcctcacaattgtattaaagtcaacttgcatacctggg

SEQ ID NO: 58938 - DNA, 331 bp, Homo sapiens
tctgttgcccagtttagagttcagtgaccatcatggctatttatcagccttgacctctaaggctcaagtgatcctcaccttttcctctggagtagctgggactacaggtgtgcaccaccttgtgtggcctaactcaatattctgatggtgatttcacaggaaggaggaggtgcttcactttcctgataagctaccgtaaggcccctttctgcatgaggctcagacctggttcaaactctcctggcagaaacaattcaaccatgagctgtgctcgaggagggcatactcctggttttcaccttctggccaacaatccaagctggggaaggaa

SEQ ID NO: 58939 - DNA, 454 bp, Homo sapiens
ggtttgggcgttttcaggcggcctcctgagaaatgtttgcaattgtaaggcgtctctctcatccaggtttacccagattcgcaaactatggcgacaaacaaccatagcagaagcatgtccggattatttcacatatatcacaaaatcctgcaaagggtctgtccccattggatcacctcccatcacgccacacacgacgtgaatgacttcgtgcttctccatacctgcattgatctctgggtccattgccagttataaacctccaagggcaatagccatgaggaaggaggaggtgcttcactttcctgataagctaccgtaaggcccctttctgcatgaggctcagacctggttcaaactctcctggcagaaacaattcaaccatgagctgtgctcgaggagggcatactcctggttttcaccttctggccaacaatccaagctggggaaggaa

SEQ ID NO: 58940 - DNA, 239 bp, Homo sapiens
atgaggaggtgaggaaaaggagaagtgcagctaccatcgagtgattcttctgggataggtgtctcatttaaatctcataatcatcttttttggcaggtcagtcaacttcaggctcacagatgacagacagttggcccaaagacacacaggaaatacataagtgacaacgaaatacaagtccatgaattaaaaaaccatgcttttctctccttgccacacagctttagtttgaaaaaaaa

SEQ ID NO: 58941 - DNA, 497 bp, Homo sapiens
acgacatcgcatatctgaagaaccacttttcatggtaaaggttttacaagtgctgctactgattgtgcaagtattaacttttcctacaacttaacccgtaaaggcatatatgattctttttgttctttgaacctttttccaagttacctactttcttttccttttgaaatttctaattgaatacatgatctcatattgagcagagtatttatgaacttatttcacttgctttggatccttggaaaattgttaagtcttagccttgtttcccaaaaacctgcatgaatggtattctctgtatagtggacatgagtaaatattagtgtgacacctagtttagtgacagaaaagagaacagttgtgctttgtcctttgtagatcaaaaggctaaattaaaggactgcaggcttcttgtgaggactttgtccttgtttagaatatggaggtaaaaatagatcgctgtttgtgaatgaaactctaaagatggtagcggccgc

SEQ ID NO: 58942 - DNA, 304 bp, Homo sapiens
tatgaaggactattcctatacattagagtgaatttgagactatctccatcattctccagccattcttcagtgggagaaaaacggtggaattaaactagtggaaacaaggctttctcatctagtcccaatccagtcgataagctgtgtttgccaatcactgctccagcacaatggccctcagtttatttttaagtctatggcatgcctgaaggaccatgttcccatgagtgacacccttctgtaaatgtggtggcacattatgggctgctgttttagaagagactgccaacttgctggggattat

SEQ ID NO: 58943 - DNA, 554 bp, Homo sapiens
atgaaccacgtggatgtaactgagacactgaaaaggccatcgtagcttattgcccactgtcctgtgagaacgcacacatattcccaggtaactacagctcgagtgcacacatcatttgcattttgttttctcatttgccagagcaaacatttccctgtgttttcttcacagtttctatgattataatattaatgggtgcataatatttgtttagatctatgtatagtgattcactgaagccaacccctattgttgattctctccttttcttttcttttcctctccctctccccttccttcctccctccctccctccctccctccctcccttccttccttcttccaccttccctccctccctcccctcacctcccctcaccttccctcttcctcaccctaacacttaggctggagtgtaatggcataaccagggctcactgcagcccctaccttttgggctcaagtgatcctcccactcataggtgtgtgccaccacgcccagctaattttttgatttttagtagagacaaggtctcattatgttgcccaggctg

SEQ ID NO: 58944 - DNA, 433 bp, Homo sapiens
tttgtccctctcttactcatttttagaaatcatgtttatcgtttgcatttcttaaactattactaaagctcccttttctctgcaggaaataagctgcatgcattctttcactttgtgttgagctagtttctgtaattgtgactaattatttccttccttaattcactctactgtatctacctaaggtgcccctggagtttcatttgggtaattagtgccttcatatgtaatctggagtgcaatttctgtacgtttgccagatgagattgtacaatggctgtccagctcagctttcagtaaatagtcttatagtaatgactgtggttacttaaaggaatcagcatgatcctgcacagctaggaggcctcctctaattaaccacattcactccaggcttagggaagccctctacaaggaaactttatgaccactt

SEQ ID NO: 58945 - DNA, 397 bp, Homo sapiens
gcccatgaagcagctctcgtggattggagtctcatgcctgcagctctcccatactggagttgcatgctggtggtcctacagtgctggtgtctgggcagtggcctcactcccatggctccaggaggcattgccctggtgagggatctctgtggtggctctgtccctgtgacaagtttctgcctgggcttccaggctgtccatgatatcctttgaaatctaattggaggctggcatgaccccatggcttccacactctgtgcacctgcagaatcagcaccatgtggacactgccaagacctacctaccacttgtgctctctggagcagcagcacaagctacatctgggcctgcttgagccatggctggggctgccaaggagcagagtcctgaggtggcc

SEQ ID NO: 58946 - DNA, 690 bp, Homo sapiens
aaaataaaagtgaatataaaatgaataattttcaaaacatgcttataaatataaaattaaaaaggaggccagacgctgtggctcttttccagcccacttgtctacgctggatatcctgagggcacttgattttgtgaccccaggactaagtcaactctgagggctgtcagcctggagcatacagtcttatccactgttagaatgtcttttactgaaataacatttggcataaaacttgtagacataaaacagtctgcagccattcgtggtggctcacacctgtaatccagcactttgggaggccaaggcaggcagatgacttaagtcaggagtttaagaccagcctgggcaacatggcaaggcctgttctctacaaaaaaatacaaaaaattagctgggtgtggtggcccacacctgtagtcccaggtactggggagactgaggtgggaagatcacttgagctcacttgagctcgggagtcagaggttgcagtgaactgtgattggtccacactgcactccagcctgggtgacagctgtcaagtaccctgtctcatggtacttgcagttgatgctcactctttgtccactgaaatagttgcttcctttatctgctgtggcctcagatgctgaaagccttgacataatttccaaactataattttgtattggtaactggggaatcttttca

SEQ ID NO: 58947 - DNA, 495 bp, Homo sapiens
agcaagaggttggtgtggctgttaatttcttgcaaagatagaggctgttcacttactgcacagccatttcaacatggcttacaaaagcctttcttgacaaatcacttacctgttccagaactctgttatgaaaatccagagcttataatattttgaaaggcaaaagattgtctcccattacttcttatctgcttcactattgcataatgaatgagcttcacctgtggcatgttggaatgagccttatgatccaagtacattattcccgaactttgaaaaatactaatgcttagcttcagacaatactgatggatcaccaaagaactgtctaacgcaggagtttgcaaacattttttgatagaaggccatttgttctggtaaaagatccagtagtcaactcaacttcatctattcctacttttctgcaagagcttggggaacatgctatattttgctttatgtataccaaattttggtaaaccataataactcagt

SEQ ID NO: 58948 - DNA, 398 bp, Homo sapiens
cagctggggaggggacagccaggactattccgagaggtgcctttgcctccggaagaagagcgtggccatttcctgtggaggagttacactggctgtggcatggcctgtgttctggggtcatccccaggccagtgacctcaggcccgagtttcttccgtgtgggtttgcttatggcttgacgttgagtcacagatagcaaaatgtgataccctgtgtgggctttttgaagactcactcctggaacctcattgacaggagagaaagaaaaggcagggataggatcagagaacatgatggtgtgtagtttttcttaaaacatgtgatttaggttagaaaccctgtatttaaattaccaatcagtaacagaatatgttggcattgaaaataacatgagcatt

SEQ ID NO: 58949 - DNA, 123 bp, Homo sapiens
cttgtatttttgaaagtgctcttggattatagttttaaaaataacctctgttaacttaattttcttcctcaataacataaatattacagttttccattccattactttttctctaatcttttt

SEQ ID NO: 58950 - DNA, 392 bp, Homo sapiens
tgttccacactgccagagcattgtacaatcagggactcacacagctgcagcatgagagggatctcagggccactgagtcctgctccgtgcccaggctgtggatccctcctgtgatggggagctcactgcttcccagcccagcccaggctattgtcacacaggcccagtcacccacaccagcccctcaccagcacccagaatcctccctcccctcctaccaagctttcgaacaggcttttccaactcctgcctcctttggataagcagaaaaattggacacccttcctgcagcttaggcttatgggaatgacacttgttttatctacttgccaaaataaaaattgtactagagaacatgtttctggaatttggatttgccttgtcttaggtca

SEQ ID NO: 58951 - DNA, 2655 bp, Homo sapiens
  misc_feature (3)..(3): n is a, c, g, or t
  misc_feature (5)..(5): n is a, c, g, or t
  misc_feature (7)..(7): n is a, c, g, or t
ggnanangctcttcctctcctctcctcaacagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58952 - DNA, 864 bp, Homo sapiens
cagcctctctcagaaggtggccacctctgtcacagctctcctgggttttgggctggagtaccctggatgaggacagcacaagctcgtactccacccggggctccgggagtgcttggtgcttcccgaggaaggcaggcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcagggaccaggtttggggtagttcttaggaatttcc

SEQ ID NO: 58953 - DNA, 2556 bp, Homo sapiens
gtcgcgataaatgggcgccggcggagcggagggagatccgagcggcggcggcaagctggctgcgagcggctgagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58954 - DNA, 1809 bp, Homo sapiens
aggatttccacggggacgcagccaaaccatatcaccttggctgtggcctccactgtgcctgggactggccacagagagctgtgtctccgtggctgccttctccttgcctgtttgcgtggtctcgaggaagctgcacagcagggcccgagtcggccgtgtgagccgctctccctgtcaaagcacacccatccctgcctgctttgacctgaacttggtgaccttcaggccatcagtggagtggggcagaatgaatagcctgtcctggctcatggcagccaccgggtgaggcgcctgcatgcgtggctcggaggccttctgcaggcacaacccccaccgtgggcctggcagcttgtgtgggaggcgtgcgggtcggtggcagagggtgagcaccagccctgtgtgaaccttcacaactcctctgtggaccctggacttggcttcactgctgcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58955 - DNA, 2697 bp, Homo sapiens
gtcgcgataaatgggcgccggcggagcggagggagatccgagcggcggcggcaagctggctgcgagcggctgagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58956 - DNA, 2513 bp, Homo sapiens
tacgggtgaggtacagctacgggtgaggtacagctacgggtgaggtacagctggctgcgagcggctgaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58957 - DNA, 1798 bp, Homo sapiens
gtcgcgataaatgggcgccggcggagcggagggagatccgagcggcggcggcaagctggctgcgagcggctgagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcagttggtggtgatgtatgggcggagcctccagtgctcttggctgctgtgacagggcccccctggggtcctgcactatcccagcgagacccccaaagcaaggccagcagagagcttcctgacagctgcctcgctttggcgacagccctggctggggtgcagcctgtgcccctctccgcccccttgtgaagtttcggatgggcgttcccagcagtgctgacaggctcacgccgcccttgggcttcattccaggtgcagagagctctgatctcccacgatcggaagtaccgtgtgcgttgtcttacctgggcagaatgcagagaccttcactggcagctgtgtgtggaccctggggctctgttacacagccaggtgctgaggagcagggctccgagccaggccagcgaaccttccttagaccccctgtgtgcaggcctggtgcctggtgtcgggggcccagtggagaacaagatccggctgttgccatgggactttcgtctggtggggagtcctgaggaggatgtggatgaggtggagaagaggttccaggtga

SEQ ID NO: 58958 - DNA, 1643 bp, Homo sapiens
aggatttccacggggacgcagccaaaccatatcaccttggctgtggcctccactgtgcctgggactggccacagagagctgtgtctccgtggctgccttctccttgcctgtttgcgtggtctcgaggaagctgcacagcagggcccgagtcggccgtgtgagccgctctccctgtcaaagcacacccatccctgcctgctttgacctgaacttggtgaccttcaggccatcagtggagtggggcagaatgaatagcctgtcctggctcatggcagccaccggcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaa

SEQ ID NO: 58959 - DNA, 298 bp, Homo sapiens
tttttcttgcatctgttcttccagctcacaggccccttcccctcacgacatggaaagagagatgagtttccactaagacaagaccttagctctgacttgatgtcttaagcaggagatgtaaaacctaactcacagtgtccgcggggtcctgaatttctgttccacccctttcagccaactggcagcttggactggagttagcgacagatgtcttctgagcaggacttacagggagtgagcctgtccatggcaagctccagccagctctgctcctcctgccctacctcttaggtgaccc

SEQ ID NO: 58960 - DNA, 445 bp, Homo sapiens
tccccgcactaaggattgaaaattctagccaaacctggatttagcagatggaggctgaagtctttctatattagaaataaaacctcatctttgatccccatcaactcccgctgcttacgtgtctttaaaccatgttccaaccctaaccacagcctatttcaatgtgaatctcaaacttagttctaacccaatgctaaatcaatctaaacccagcctttgatttagccctaactgtattcccaggcagagctgtaaatgaaactaaaactctattccttatcgtaacacaaatcccagccataaacctgagcctcaattctagctgtatttctaaccctaatcccaaccttaactctaatcccaacctcaaatctgacctcaacctcattcataattcaactaaccccaaacttaaccccagctctaacattagcccacatccaga

SEQ ID NO: 58961 - DNA, 218 bp, Homo sapiens
cctcaagcaatcctcccccctcagcctcccgaagtgctgggagtgagccactgtgcctggccgaaatgcccaatttaaaccccgtctgttctgtctcctgctgaaatagaatagacaaagatgtggtttgtgttggatgctttactgctagagagtgaactgtatttttttctaagaaagttgaaggctcagtgggtctagaatctgatggctggacc

SEQ ID NO: 58962 - DNA, 308 bp, Homo sapiens
cctgaacagtctgtttcatttgactgtttgggggtctcccagtttaagcaagatatttaagccttatttctcttggcatgcttggattccccagtaaaaaaaactcctgccctgggctgacaatcaaagttctgggaactaatatggataagcaagctggaaatggagaaggctattcactgtgcctgggtcctactgttttctggatgggaactgctttccattaggcctggtgtgccctggaagggagagcctctgcagagactacatcttggatgggtctttgccaagtttgaggtagaaaccca

SEQ ID NO: 58963 - DNA, 320 bp, Homo sapiens
gactccgtttcaaaaaaaaaaaaaaaaaaggccaaaaggccttctaatataacttacaaaaaccaatagcatttctctgtacacgtactatacaaaactggaaaaattaagatagttgtaatagttagaatgtctataaagtgcttaggaattgatttaaaacatacataagatttgtctggagcacaccataaaactctaataaagaatataagaaatgatctgagtagatatattcttgtttttgattcaaacagcttaataaaattgtcaattcttccttaattaatctatacattcagtggaaacttattaaaaat

SEQ ID NO: 58964 - DNA, 317 bp, Homo sapiens
ctgttccacctcagatcatcaggcattagattctcataaggagtgtgcaacctagatccctcccatgtgctgttcacagcaggatttgcactcctataagaatctaatgccactgcagatctggcaggaggcggagctgaggtgggaaggtggtattgctcgctcgctcgcctactgctcacctcctgctgtggggtccagttcccaccacagaccactggtctgtgactcagggaccactaccttctaacatggatgagaaaaacaactggattcatcacacattatttaaagttcagtttccaataacttatcaa

SEQ ID NO: 58965 - DNA, 395 bp, Homo sapiens
attggaactattcttgggtaagttagataaagggtgagaattttgcagactaaatgtagcagcaagctataaaagttagggtagataggtacatatgatagcagctggtggcctacatggggtggtggcctgtaataactcaaagggttccaatgagctattacatgtctaacatgaatagatagtttaaaaaggaagtcccatgcattttttagaggttcccaattaggacagtttgacatgtgaacaaaagtgaacaaggtcttcagcctttgaaatactgtagtgaggagttagaggaaccccttcttcttcttgaagataattataataatagaagggataaggaggcaatcagctggtaatttcaagtgaactctaagagttcctggatg

SEQ ID NO: 58966 - DNA, 1071 bp, Homo sapiens
gtgcgtgcctctaatcccagctacttgggaggctgaggcggaagaatcgcttgaacccaggaggcagaggttgcactgagccacagttgtaccactgcaccactccagtctagacgacagagtgagaatctgtctcaaaaataaaggtctctaccatgaaaccttctctgttacatgctagctgaaatggtttcctctccctctggtgacagaaacatcttacttccatcttccttatgatatgtagtacattgtcttgaattatagttacttgagtaggtatgtattcttcctgtcttccttattagattatcttcttctcccagacaggatcctactttcctttatatcctccacaattgggcactcaagtgttttcggaattaatgggagaagtcattttgttagaagattgggatttcctttgcccccatatttccctactttcagaagagctttagaagaaaatccaaagggaacactgacagcgagggctcctagggaggaaattaccttccaccttcttctgtcttgtcttggtgcattaggccgttcttgcattgctatagacaaatacctaagactgtataatttataaagtaaagaggtttcattgacttacggttctgcaggttgtacaggaagcatttcggcttctagggaggcctaaggaaggctacaatcatggcagaaggcgaaaggggagcaggcactttacatggcgaaagcaggagcaaagagtggggcagtcccacctacttttcaaggaccagatcttgcaagaattcagccactaccacatagacagcacccaagccctgagggatccaccctgccatccagacacctcccaccaggccccatctccagcagtggggattacaattcgacatgagatttgggtggggacaaatattccaccatgtcacttggctgtatcagtttagggaaatgttatgacttgctttacactcagtcagcctctgttttgccattgtgcatgaataatttgcttgggtgtattagtgcctgattctgctgactcattcgttctgctcctcagggaataaa

SEQ ID NO: 58967 - DNA, 934 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtaccagacaacgctcaaccgaaacacgtgaagacacacgacccacaggcgacaaccacacaagacgacgaacacgcacaaacacaacacgacgccaacagaaaaaaaagcaccaacgcaccaaccaacatgccaaccgccacaccaccacaccgaaaacgtgaagccacaaca

SEQ ID NO: 58968 - DNA, 543 bp, Homo sapiens
  misc_feature (2)..(2): n is a, c, g, or t
tnaggctaggtacgaggctggtgttaatcggccgagggtgtgcagctcggcccgggcccctggagctggacctgactgggcgacctggagagcttcaagaagcagtcgtttgtgctgaaggagggtgtggagtaccggataaaaatctctttccgggttaacctgagagatatgtgtcctggcgatgaatgtacgatccatgcatactgtacatgtgaaatggctgtcaatgattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtgcggtgcagtgaagaggaggagaaaagaaagaaaagggaaaaaggaagagaa

SEQ ID NO: 58969 - DNA, 1888 bp, Homo sapiens
ccggaagtgacgaggcagggcgggcggggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58970 - DNA, 635 bp, Homo sapiens
agtcaggctggtccggcccaagtcctttggatctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58971 - DNA, 348 bp, Homo sapiens
cccccccccccccaaaacctaaatgaaaattttttttcaccccccacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58972 - DNA, 472 bp, Homo sapiens
aaaaggataaccccctttctcttgaaaaaaaatatttaaaaaaaaaccccacaacattgggttaaaaaccaaattacaaaaacgaaaaatcacccaagtaccattaagggagggtgggtaatattaaacctataaatattttgtttaaaagggacaggtgcaaaaaaacacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58973 - DNA, 427 bp, Homo sapiens
  misc_feature (53)..(53): n is a, c, g, or t
  misc_feature (56)..(56): n is a, c, g, or t
taatcagctcggtaccagctcgtgctggagggtgtggagtccggataatctcnttncgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgttccctcccagcacgtagctcgtccttcctcttgagtctacctgcat

SEQ ID NO: 58974 - DNA, 154 bp, Homo sapiens
cattcggtgctgacacatgcggtgggccattcagggagtctcaccatcaagaaggactggaaggactgagcccagccagaggcgggcagggcagactgacggacggacgacggacaggcggatgtgttctgtgctagtcgggatcctatagagt

SEQ ID NO: 58975 - DNA, 893 bp, Homo sapiens
ggattggggcgcggcctcccccagcgcccgggccacgcccggcacggattgcgggccctgcggaagtgcgggccgcgccctaggatcccggcgcctacggctatcctcgcgcggcgcggaggccccagcccctggaggaagcagggcggcctggaccccggcctgggtgtcccgggtgtgctgctccctgacccacctcccacgctgccgggaaggatctgagcctgacagatcccctgccgggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtaggctccccggaagtggggcccgggcccccc

SEQ ID NO: 58976 - DNA, 974 bp, Homo sapiens
  misc_feature (11)..(11): n is a, c, g, or t
ggggaggaacntaggctaggtacgaggctgggtgtgtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcggtttttttcccccgaagggccatatcgatatcgcaataccaaaaaatgcttgacaaggggcatagcgaatgccccggactcaaaacgcgtggagcacaggaggacacctgtgagccatggggcccaaaactaagatgtgccaacgaagaccgcaccgctcctataagacgctctacagcacaaccacagaaatcgggccaaagcacacgcatcagggctgaccaggtagctcatgac

SEQ ID NO: 58977 - DNA, 953 bp, Homo sapiens
atcgtggagggggaggtgtgtcctctctccccatgatcggctgcagttcccattttgtcttagatgttatacctggggtgggggcacctcacactgccccagaggatgcccctgagcaggaatcgcgggggtggagaggagcgaaggtggcccccttggagcccttttggagctccggctgcagcccacactcctgctcagaagtgcgcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacggggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgctgaaggagggtgtggagtaccggataaaaatctctttccggcccacctctctttccggtgttagccgagaggatagtgtaccggcatgaaggtacagtccagcatacgtccaggaaccggcgtcatagatttgactaagactgactacactggtagtgcagcgtatgcgggcaggctacaggcatcaagtcctgcttcttgcctgtgctggtggggggagagag

SEQ ID NO: 58978 - DNA, 1859 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58979 - DNA, 2094 bp, Homo sapiens
  misc_feature (2)..(2): n is a, c, g, or t
  misc_feature (1885)..(1885): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaaaaaaaaaaaaaaaaaaaaanaaaaaaaaaaaaaaaaaaaaaaagaaaaaaaaaaaatataaaaaacctaaataaaaaacacataaaaaaaaaccttcagggggggccccggtcccaattccccccttatagggagcgcttttaaattcaacgggccgacttttaacaacgtgtaaatgggaaaaaccctggtgttcccaaacttaaacggccttgaatgaaaatcccct

SEQ ID NO: 58980 - DNA, 1974 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcaggtgagtctgggctgcgggagccgggtggccgcccgttcactccagctgtcttgccgctccccagcccctacttccactggtgggggtggggccctcacctgctgtcactccccagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58981 - DNA, 1778 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58982 - DNA, 2478 bp, Homo sapiens
  misc_feature (2)..(2): n is a, c, g, or t
  misc_feature (1864)..(1864): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaacanaaccaacaaaaaaataaaacaacaacaccaacgccgcaacaacagatcacaccaattatacccacacacggagacgcaccaccaaaccattacagacagcgcatacacagacaaccgttgaagcggaccccgccaacaccggggtgcaccacacaccgatgcagaagcaacacgacgaacaatcaacgacacctaagggcgagatgcactgaccgaccgaataaacaagggacacctggcgacagccgcgcagaccaaccgggacaccgcacacgagagaccttacgttgacgtagcacacaaggaacactacgtccaacctcccctggcggcacgcctacaccctcccgaatcgtgccgcacaacaagacactccacaacccaccgacagacctgaccccgcgcgcccgagcgcgaaccaacacatctcaaccgcacctttccccatgagagagaacatcagagcacgatcaacaacacacctaccggcactcctacaaacgcgcgtccgcacataagaaaactatatccacaataaacagcgagcacggtctacatcctggcgcaacaaaaacctcggacctaccctcagcgccagccccgaaaggcacaac

SEQ ID NO: 58983 - DNA, 2151 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaagacacaagaagaaaacagacaaacaacacagaagaaaaaaaaggcgcgcggcaaaaacaccaccgcagggagcaccaatacagcagcaccccgccgtcattataagaggggccccaaaagaaggtcgcacacacaagagacgagccgcagcgacaaccaccgagagaaaacgcaccgcgcactggagaagagacacaggcgggggaacacgtgacacccacagaaaaaccgcggcaagacaaccggagagggaaaacaccatgtccgcaggggcgataaaacagga

SEQ ID NO: 58984 - DNA, 2456 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggataaaaaaaaataaacatataaagaataaaaaaaattttccggccgcttgagtgcccaggaaaagctgtttttgtaagtccctcgtttacgttgttgggggtacgctgcgggccccatggttgcttgcagatggaagaacctggggtcatatagttcgttgtctcgtagagaagtactcggagggatcagtaaggataagggagctgaggggtttcccttcgcacgcattactacaaaaatacgccccggggggggaaaccaggagtggtctcttcacacataccttcccacgggggggttccccgaggcggcacgacaacggcggggttattccacagcggcggtagcccggtagggccgtctccgaatgttagagaatttaccgccccgcctcttgggggatttgcaatgcaccacgcactttgccaatctctgtctaggaagtaacaacattagaaatggactcctggtatcacatacggacggcacttgtggactctgtggcaaccagggcagttcctatatacactcttacttgctgccggtaagtgggcaactccctccaataaatcattacactcctgcttgtgtctgtat

SEQ ID NO: 58985 - DNA, 1921 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggattgcctgcgcgcgggaggtgaggctgcggcggtggtggtgcggttatgcagagcttggagac

SEQ ID NO: 58986 - DNA, 2037 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaacaaaacaacaaacacaaagacaaacacaaaaacaacaacaaaacacaacaaccacaacacaacaaccacaaacaacaaaaaaaagaaacaaaaaaggggggcgcgcgggcgcaagcaattattcacctccgacgggggcgccaccacgactgatgcccgcaccccggacgatt

SEQ ID NO: 58987 - DNA, 1995 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacggggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58988 - DNA, 1833 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagaagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58989 - DNA, 1718 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacggttgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58990 - DNA, 1455 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58991 - DNA, 1580 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctggcataaaggtgggggacaggctca

SEQ ID NO: 58992 - DNA, 1623 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccaggcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 58993 - DNA, 1250 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaaaaaaaaaaaacccacgcgtcc

SEQ ID NO: 58994 - DNA, 1471 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcataagtctgtgcatgtgtgtgtgtgtgagagtctgaggatctctgtgcatgtatgtgtgcatgggtgagtatttggcatgggt

SEQ ID NO: 58995 - DNA, 1445 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctaaacgctggttctgccgaaaggcccccttccccc

SEQ ID NO: 58996 - DNA, 1001 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcggtttttttcccccgaagggccatatcgatatcgcaataccaaaaaatgcttgacaaggggcatagcgaatgccccggactcaaaacgcgtggagcacaggaggacacctgtgagccatggggcccaaaactaagatgtgccaacgaagaccgcaccgctcctataagacgctctacagcacaaccacagaaatcgggccaaagcacacgcatcagggctgaccaggtagctcatgac

SEQ ID NO: 58997 - DNA, 990 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtccccccccccccccccccccccccccacccccccccccccccccccccccccccccccccccccccccacccaccacgcgcccggccccgcgcgtgcccgcggcgtgcgcccgccagcccgcccccccgccgccccggcgcgccccgtcgtcctccccggcctccccactccccgccgtgctccgcccccccgccccgcccctcgccccgtccccctcctcccgccgc

SEQ ID NO: 58998 - DNA, 1105 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgttcctccggacagcacagaggaggtaaaatgccatttgactccagtgctgggtctcctgtgccttctcattacagtggttacagttgtaaaaggcagctctagcccttttctccagagacagggcagggacaggcaggaagctcttcctacgtggaaggggaatccattgtggagaggatccgtatgacttctgctcgctgagtgggtgatatgtgctgcgtcatatggatgatggaatccatggcaacctctggattggcgtggaccaagctgcggatttgcttgaggacgtagtctctgctgatgcatttgatgttttcctctattaccgagtgaacaccat

SEQ ID NO: 58999 - DNA, 814 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtgcggtgcagtgaagaggaggagaaaagaaagaaaagggaaaaaggaagagaa

SEQ ID NO: 59000 - DNA, 789 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgttctgtgctagtcgggatcctatagagt

SEQ ID NO: 59001 - DNA, 977 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaacacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59002 - DNA, 712 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtaggctccccggaagtggggcccgggcccccc

SEQ ID NO: 59003 - DNA, 742 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59004 - DNA, 667 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttccctcccccgccccatccccggtcttcgtgttgtgtctgccaggctcaggcagaggcgcctgtccctgcttcttttctgaccgggaaataaatgcccctgaagga

SEQ ID NO: 59005 - DNA, 552 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagaaagactactacactggtagcagccacggccatcgtaacggggggcgcg

SEQ ID NO: 59006 - DNA, 2090 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacggggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgctgaaggagggtgtggagtaccggataaaaatctctttccgggggtaagctacaggctgctgtggccagggaatggaggcggggctggggctggggtccggaccgaccttccctgatcctcgcttcgggtcctgcaggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59007 - DNA, 1772 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagccttggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59008 - DNA, 1071 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccggccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59009 - DNA, 1066 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59010 - DNA, 1229 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtgcggcgtgatcctcaccggggttcttcagtattttctagccactcctcccagctcttctgtgctgtccacttgggaagctaaggctctcaaaacgggcatcacccagttgacccatctctcagacctctctgagcttggaagaagcctgttctgagcctcaccctatcagtcagtagagagagatgtccagacaaaaatatctttcaggaaagttctcccctgcagcaatattggtttccttctgttaaatatcaggaatatagggccgggtgcggctggctcaccacctgtaatcccagcacttctgggaggctgaggctgggcggaacacctgaggtcaggtgtacgacaccaagcaggcaaacatggtgaaacccgtccctactaaagatacacgacaaatgagccggcctggtagcacgttctgcatcccagtagaggctaggcacagaatctctgaactgaa

SEQ ID NO: 59011 - DNA, 1009 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtgtgctgagctttggaattcctataagaaataaaatgatctatttcagtgttccttcgctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataa

SEQ ID NO: 59012 - DNA, 808 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgttccctcccagcacgtagctcgtccttcctcttgagtctacctgcat

SEQ ID NO: 59013 - DNA, 899 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccatgcacaagatggctgtggcatgcggcatgaacctgactgtgactggagctgactgtgaaccaggccgtgattgttgtccgccgcacaagaagcctgaaccacaccataacgcagatcgggaagacacccacggaacgcaacaaaagagtatgaacaacaggaacaacacgaaaggacaaacacagcagac

SEQ ID NO: 59014 - DNA, 781 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59015 - DNA, 959 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaacaaaacaacaaacacaaagacaaacacaaaaacaacaacaaaacacaacaaccacaacacaacaaccacaaacaacaaaaaaaagaaacaaaaaaggggggcgcgcgggcgcaagcaattattcacctccgacgggggcgccaccacgactgatgcccgcaccccggacgatt

SEQ ID NO: 59016 - DNA, 696 bp, Homo sapiens
  misc_feature (2)..(2): n is a, c, g, or t
tnaggctaggtacgaggctggtgttaatcggccgaggctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagtggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 59017 - DNA, 917 bp, Homo sapiens
gcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaggagctgggggtgtctgctgcttg

SEQ ID NO: 59018 - DNA, 1785 bp, Homo sapiens
gcggccgcctcgcctccccacccctggccgcccctccccacctcgcccaagggggccggaacggcgtcggcgcgcgggggcttttcggagcagtcgagtggaaaatagactttaacccgctttgtggcggccggggcgccctgagcgctctccaaaccacggctcccggcgctcaggcgggccgctgccaagacccggcctggagtccccgcagagttgcgcggcgcacggaccccgtggccttggggcgtcaggaggcccaacccagatctgcgcgcccaggcagcgctcaggccgctagaatggaccccggcagcggcgaggaagcggaactctctgcggctccctctccgcagtgcgccggcaaggtccaggtcccagcctccccaccgccgcccgcgccctcctaggcctcggagcggcgcctttctgcggcctcgaaggtggggtgggaaagtttggggagtcccggctctcacagcctgtcgtgagaactgcccccggggaattcgtccgccgtacggaaaaactggccggagcagagtcgtccgcggttccgcggtcgcgggtggaaggtgacaggtcgagggaggtcaggctgcttctgcgtgtcctgacggctggcgtgttctcttgagatgggctcgggctacttggccagcttcaatttaagccacagtgtctccgaggccctgacctggtccggcccgccgacacttgagcccccagagcctcagagaaggcgagggggtggatctcccagtgccgaggcccgccgtcctggtccaagccggtcgcggcaccgtgtctgggcactggagctgcttccagccccgcgaacagctggagggtggcagtgggaccgctccggcggcttctcccgcgcagtgccccgcctggccccttgtgaagggagtgagcgtcccctttccagagctgtcccccgtgacatccagaaaacgcgaaacctcaggaacaaggtcgcagcttcagaccgcggcccaggaggccgatggtggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccag

SEQ ID NO: 59019 - DNA, 1192 bp, Homo sapiens
tggggcaggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtccgacgtgttggagtggggctcagcgaccctcagcctagctgctgccctggaggtggatttcagtctctgcgtgccggccggctcccagagttgcgagagg

SEQ ID NO: 59020 - DNA, 1041 bp, Homo sapiens
tggggcaggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattccca

SEQ ID NO: 59021 - DNA, 819 bp, Homo sapiens
gtttttaatgagttagtagcctgagcattcagccgcaagactagtgcaagcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccag

SEQ ID NO: 59022 - DNA, 405 bp, Homo sapiens
  misc_feature (25)..(25): n is a, c, g, or t
cgcaaatcccacgaaggcagagtgngcttgctgctggccaggcccctgtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactaggctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccag

SEQ ID NO: 59023 - DNA, 485 bp, Homo sapiens
tcctccctgtccttgtctgtccaaggagaatgaggtctcactggtggatttcggactaccctgaggagctggcacctgagggacaaggccccccacctgcccagctccagcctctgatgaggggtgggagagagctacatgaggttgctaagaaagctccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccag

SEQ ID NO: 59024 - DNA, 1670 bp, Homo sapiens
tggggcaggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccag

SEQ ID NO: 59025 - DNA, 2520 bp, Homo sapiens
ccgccggctttgtgtgccgcgcgcgggcccgggccgcccgcgcctcgcctgggttccggggccgccgctgacccgcccgggctccgagcgccgcgcccgccgggccggccccgcctcctgccctcctccgcctccgcctcctcctgccgccgggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggcgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 59026 - DNA, 186 bp, Homo sapiens
atgcatcgagctcggcacccagggagccctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 59027 - DNA, 1534 bp, Homo sapiens
gctcatatttcttactagatctttctctggagccagtttgcgaacacatgcgagacctttagacattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 59028 - DNA, 1522 bp, Homo sapiens
gtgataggtaaggaaagaggcaggaggaggggaagaggccggggcctaggtcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 59029 - DNA, 2291 bp, Homo sapiens
  misc_feature (2121)..(2121): n is a, c, g, or t
  misc_feature (2127)..(2127): n is a, c, g, or t
  misc_feature (2150)..(2150): n is a, c, g, or t
  misc_feature (2194)..(2194): n is a, c, g, or t
  misc_feature (2209)..(2209): n is a, c, g, or t
  misc_feature (2227)..(2227): n is a, c, g, or t
  misc_feature (2247)..(2247): n is a, c, g, or t
  misc_feature (2250)..(2251): n is a, c, g, or t
  misc_feature (2263)..(2263): n is a, c, g, or t
  misc_feature (2274)..(2274): n is a, c, g, or t
ccgccggctttgtgtgccgcgcgcgggcccgggccgcccgcgcctcgcctgggttccggggccgccgctgacccgcccgggctccgagcgccgcgcccgccgggccggccccgcctcctgccctcctccgcctccgcctcctcctgccgccgggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggcgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgatgatccttgtatatgtntatccntgtttgctttaaattttaacttncagacaaatcagtttgttgaaattgtttaattctaaatttgtgnattgggtgcgggggncaactaaaaaggagtacntggggggggggggggaacanaanngggagaaggggngaggggggggnggaaaagttggagtttg

SEQ ID NO: 59030 - DNA, 933 bp, Homo sapiens
ttcatctagactacttcatcatacctacccctccatatgccaaaaaggcaaataaataagtaaactcaaaacatcaatgtcatatttaaatatagtattttttcagattttaataataaacaaaccctagaagctgattcaattagtggtcaaatccagattaggctatattaaaactagtcctggtaggtatgatgcgtccttcatcatacctactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 59031 - DNA, 2055 bp, Homo sapiens
ccgccggctttgtgtgccgcgcgcgggcccgggccgcccgcgcctcgcctgggttccggggccgccgctgacccgcccgggctccgagcgccgcgcccgccgggccggccccgcctcctgccctcctccgcctccgcctcctcctgccgccgggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggcgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggagctttgaacgagatatacaccaggactacacaatcactgccgtaatgtaccgtgacagtaccagg

SEQ ID NO: 59032 - DNA, 2292 bp, Homo sapiens
ccgccggctttgtgtgccgcgcgcgggcccgggccgcccgcgcctcgcctgggttccggggccgccgctgacccgcccgggctccgagcgccgcgcccgccgggccggccccgcctcctgccctcctccgcctccgcctcctcctgccgccgggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggcgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgttttacctactatcggatcggtgtaaaacagaacggccatgaacacaagccaagacgcatacagctagactatagaggatagccaccgcattcgacagcgatcagcaccaagattcaatccaggcatgggacagccagaatcagcgcgatcgcagatctg

SEQ ID NO: 59033 - DNA, 973 bp, Homo sapiens
  misc_feature (756)..(756): n is a, c, g, or t
  misc_feature (762)..(762): n is a, c, g, or t
  misc_feature (770)..(770): n is a, c, g, or t
  misc_feature (772)..(772): n is a, c, g, or t
  misc_feature (780)..(780): n is a, c, g, or t
  misc_feature (789)..(789): n is a, c, g, or t
tatctcgtgttaatgtgaatgaccgggcgggggttatagtacgaacttgactggccgtcgttttacacctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttantaatcnaaaggatnangcccaaancccaggcangagatgacatcacagtggtaaacgttgagaagcaaaatgagggcttccgaagcgctgatccagatgccgggggaggctcttggtcccccaatcccagacaaagtgccttgtgaagccctgcctctatgagaggattaacctatgcaaccctcaaaggggaggctgaggcgcactaagcaaaacc

SEQ ID NO: 59034 - DNA, 595 bp, Homo sapiens
ggagaaaactgtatggcaaatacatattttctcctgtatcaaagaaatttaaatcattttaagtcactctggacctgtttcttcatctgcaaaacagggaagttatagattagatgatccttatagttccctatatccttaaggttgtgtggttctatttttgaatttaaaagcagcttgcttttacagctcaaccccaggttctgagaggttcaaatagtatgttctggcaaaagggattcaggtaggtgaaattgctaaataaaagcatgctgatggtttgagtagttctccctgaccttgtgtgtgctttataagatcctttagtagtctctactctcgatgtacactggtggggacctcctcccagccagagagtggctccttgccagaccctcacactcatctgtgtcctatgttctggactcaggattgtgtgccagcttcagaggatgctctccatagccgtagaggtggacaggacccccacctgcagctccaataaaattgccgagatgatgtttgggtttgtgctggacattcctgagaggagccagaggtgagtcttgattttgttggggagagcagttattta

SEQ ID NO: 59035 - DNA, 1340 bp, Homo sapiens
  misc_feature (1123)..(1123): n is a, c, g, or t
  misc_feature (1129)..(1129): n is a, c, g, or t
  misc_feature (1137)..(1137): n is a, c, g, or t
  misc_feature (1139)..(1139): n is a, c, g, or t
  misc_feature (1147)..(1147): n is a, c, g, or t
  misc_feature (1156)..(1156): n is a, c, g, or t
ggatcatttcacctgtaacagaatacccaactcaggcttggcccaacagtcaagttgagccaagccaacagacttggctcaatcagctcgcatgactggaagttcatcagtagagtggacatcatggcggtttgatctagcagcacaggagtcattaaagaaccagtttctctttctctgttttgccatctgtagttttgggtatatcctgaggttgataggttcagtgagagggagagattgacttcccatggctgcctcttaaatcaaatgatctacaatcctagagattccagtagatatctgattgcagcttaggtgttagaaaattataattatctgcagatgcctagatcctttgaacaagtaataatacttaaaaaatggtttctgaaaccttataagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttantaatcnaaaggatnangcccaaancccaggcangagatgacatcacagtggtaaacgttgagaagcaaaatgagggcttccgaagcgctgatccagatgccgggggaggctcttggtcccccaatcccagacaaagtgccttgtgaagccctgcctctatgagaggattaacctatgcaaccctcaaaggggaggctgaggcgcactaagcaaaacc

SEQ ID NO: 59036 - DNA, 1518 bp, Homo sapiens
  misc_feature (1301)..(1301): n is a, c, g, or t
  misc_feature (1307)..(1307): n is a, c, g, or t
  misc_feature (1315)..(1315): n is a, c, g, or t
  misc_feature (1317)..(1317): n is a, c, g, or t
  misc_feature (1325)..(1325): n is a, c, g, or t
  misc_feature (1334)..(1334): n is a, c, g, or t
agcgggctcggggcggggccggcgtggcggtggcccgggttgtagccgccgccgctgccgcgcgcccccgccgccgccacctcagaagcaggaaccgaagtcgtcgccgccgccgccactgactgggtcttcggtcggggcccgcagccatggaggatttcatcgtgatctcggacgacagcggctctgagagctccgggggcgccctgcccgggccggtcgcggaggccgcgccgggccctgtcgcgaacctccggcgctgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttantaatcnaaaggatnangcccaaancccaggcangagatgacatcacagtggtaaacgttgagaagcaaaatgagggcttccgaagcgctgatccagatgccgggggaggctcttggtcccccaatcccagacaaagtgccttgtgaagccctgcctctatgagaggattaacctatgcaaccctcaaaggggaggctgaggcgcactaagcaaaacc

SEQ ID NO: 59037 - DNA, 789 bp, Homo sapiens
gtccttccagccatgtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctggcagaaaccactactgcctcctcaagtacctttgccagttcttgacaaaagtagccaagcatcatgtgcagaatcgcatgaatgttcacaatctcgcca

SEQ ID NO: 59038 - DNA, 408 bp, Homo sapiens
ccactgtactccagccggggcaacagaatgagactccatttcaaaataaataaataaataaaaattaaaaaaattaaaaataataaaaaaacattaaggtagaaaagataaatgaagttaagaatttggttggcgctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgac

SEQ ID NO: 59039 - DNA, 874 bp, Homo sapiens
atggcaacagcagagcattaggccaagtatgaggtcattatgtacatgggtcctcgtgtgaccacacaggtcacaggaacatgaagctagacctgagtgtatattcagataggtaaatcttacagatttttaaaactcaataaaagaaaaactacatttcatgtataaacacaaaaattggaattaaattggcaatagcattgggatttgtgctcagagtcacagtttacatctgaccacaatttccatatgaatttattaagataaaacagtaagaattttaaagaaggtttctgaaatttaaaaattataataacataattaactttgatattttaattccatgtaatttaaaacatttaatagatatataatgttccactattaatttaactagaagtataaaaataaaacatatataataaaaatattctacttacttttaaattatctatattatactgagtaaaagaaaatttaggaatataaataaatgagcatttttgaacacataaaaatattttcttgctgtttttaggagacttttagcaggagaggagcttacctctcatctacctctgcttggacaaaccagtgatgtgatttgcaaataggttgtaacttcacccaaaacacatcacagtaaagaaatgtagtgacttccagagaatttgacctaactaagaatttgtaaaagagaaaagcattgtccttatgcctaaagtacatgactgtttctttttaagttacatgtatatttacctgaccaatttgttttactctgtatttcaagttatcaagtgaaattattttggaataaattaatgagttgtttgttctgaataaatgtgcatgttacaaatgcaaacacgtg

SEQ ID NO: 59040 - DNA, 673 bp, Homo sapiens
cttagctgctgaagaaggagagtcgcattcagccagggatcactgagcattcaaaagtccatctgagacctgctttcattgcactgcctcgtgaggagctgtaggagaagatatcataactattccccacttctaattgttagaagcaacagctgtctatcaagaacaatctgaggattgtgcacaaattgatttggttctatcaagtgctggctttcgattccagtctgacttcactaccacaggagcttcttgctcaggcttctgttccggctccattctctccctgccattataatgccatccactgcagcaccatctcttcaatcagaaaacattcatgatctcattccacctgaagccagtgcctctgtaatgtgtagcagaatcctatggagaagttgtaaaaacacaaaatgttggccccaccccaagagtttctgattttgcaggtctggagagggcctgtgatacgtacttctaacaagctcccaggcgatgctaatgttgctggtctagaaacacactttgagagccactgttttacaatgtattcacccagcttatgcaatcaactactatcacagcaaagtccaaagaatgctccttatttgtttgttatactggagtttggcttggctaaatattatttgaaactgaatggctgttgatt

SEQ ID NO: 59041 - DNA, 192 bp, Homo sapiens
  misc_feature (189)..(189): n is a, c, g, or t
  misc_feature (191)..(191): n is a, c, g, or t
acgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctgggnant

SEQ ID NO: 59042 - DNA, 757 bp, Homo sapiens
tttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactgtgctaagtactttattttatttaatccccacaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggc

SEQ ID NO: 59043 - DNA, 251 bp, Homo sapiens
aaattttaagggtcatttcttactttcccagtgattgtttctccctggctggttttcaaaagcatttggggagtttcgtgtttaaaacagtttctttggcttcatcctggagtttctgattcattgagccttgggtagaatctcaaaatctgtattatttttaatttccaaatgattccagttgctaggtccatcagatctaaccctctttcaaacacaaagcaggtcttccttgttggaagaaagaaata

SEQ ID NO: 59044 - DNA, 452 bp, Homo sapiens
tgtgagcatagatgtttgaatgcagactatactgtaggtttcacatttaaacatatttgaacatatttagggacaaattattaaaatagttatatgatcaggcatatcataagtgatagaatattcccagagtttgaatattttgcataaaagatacagggtaggcaatgatatcaaacatctaaaccaaattggccattccaattattttaatccagggatttttctgttataaagtttgagaagtagaaaatgggctttctccttattttttaatcctttacagaattaattttatttcaactcgagttacatctggacttttgccattaaaaaaatactgcttggttcaatccttattagcctcaggtaaaagacatctcaggaaaagtgacacaaaagaggcaacctctaagttttacattttttatctcctccacagttcttctaat

SEQ ID NO: 59045 - DNA, 896 bp, Homo sapiens
atgtgtttaggatgaacacatagatgaaatgcataatatgaacatgagccagtacttaaagagctcgtggtgtgtgccaggagtgtgttttccatgcattcttcctgagaagtaggtttgattatacagtatctattttacagataaaggttgaggtcttttctttctaaggtgttattagacagctatagacatggacaccaaaacttgttgagccttcagcattgtaaaggcttggcttaccttccatcaccctcagcagttctgctggaagggaaaaatggaaacagggcccttaattttttctcattattggattaattggaagcactaggcatggtgtgctgcctggtggatagtagaggctcagtaaatgtttattgaatataaatctgaatcagaccaagtgaaaaaaagatagagaaaagcagtattagatcctggccccagactttaaaaaagtctgaggtcaccagagattttattagcatagtccatttgttaatattgcaggttaatggttggttgaaggctgaggtgaagaattgtccagtgtgtgttgcatgggattaactccagtctgggcaatttagttatctctagaaatctgttcacttcccactaggtacccctgctgctcaagaagctccaggctctgtgtttgtgttcagctgattcatttattcccaattaaaaaaaaaaacaaactagttgtaacattaaaatatgcaaataagataggtgtgactatcctaaataatcctatgtaactattctatttaaacataaataggaaggtataactgccataagtcatcacgagtgtatttcaaagccagatctgattgatatttctgtttacccttagctcaggtaattaagagttgacaccaagg

SEQ ID NO: 59046 - DNA, 332 bp, Homo sapiens
ttctttcttcttctttttttaaaggtcctgctttaaaaaccagaaggacacagagcccaaagttaggtcatgaggctttggccttgacaccaagggatgctgtctccttgccggaagcagctcaccaaagccggcagagaacccaggttccgtggggccacgatgtggggctccgcgggcgccccggcgctggccgacttcctgtctcctgggtcagatgctgctccgcactgcagctatggtcgcatgcagtgcctgccgaagcccgcagcaggaatgctgccttcggtgattttaatttcacttttctacttctctcaataacaaaatcc

SEQ ID NO: 59047 - DNA, 350 bp, Homo sapiens
ttcagaagcaccttcttgctaccgaagcgcctctctcagccctgacccttgtggttgagcatgcttccagcctgggcagtgcatggctgctctggagagaaatcccatgttatacttcaaactcgggcagtgcatgcctcccctgcagagaaatcctgtgtttcaactagatatttgtaacacctacatccttacaatgcagttaatcagatgatttatgtatttttagttgcgtagcctagaatgaatccagtttttttatgatcttagctttaacgtcgtccacaccccagtttgtccccaacaaaacaaaccagcaagatatttaataaatatttgtctttgtcatt

SEQ ID NO: 59048 - DNA, 301 bp, Homo sapiens
tgacccctgaccattttatgtactcaataaatagcaactataattcatctaatgataacaatgctcattttgaagctttaaaaatatgtaaaagcataaaggagaaagtagacataatctctagtcctaccactcagaggcaacaaatgttaatgttttagcatcttttcttcaccttccattcacacacatatatgtccacacagttgattttgcagtgtgcaaacaactttgtacggtgtgtattagccagggtttcatcagagaaggagagccacctcaagtcaatggtaaggagatc

SEQ ID NO: 59049 - DNA, 412 bp, Homo sapiens
gctaatttttaaatttttagtagagacggggttttgaactcctggtctccaacgcctgacctcaagtgatccacccgcctcagcctcccaaagtgctaagattacagctcgtgttcttcagttgtcttccctacgctgctgcctcggcagtcactatctcctcaggaagcagtcccacccgcccctttctcttccacggcatccacaccatccggatgcctggattcaaatgccacgtcaccacttgccagctgcagtgccttcgacaagtttctcaatcactctgtgcctcagcgtcctcctctgtaaaacggcgaatgatggtagcgcctacctcataagcttgtgaggattaagtgagagtctatccagtgttgaggagagtggcataaataaagcgcctagtggtagc

SEQ ID NO: 59050 - DNA, 325 bp, Homo sapiens
cgcaaggatcaggaactatatccagaacaagcaccacttccaatgctagcttatcattatagactcatcttatcttttattatttctggcctctgagaagcccttactttgtctccagtggagccaggaaataagagttttgatttattttttcaatccatcattttttagtgtgctaaactgcaatgagtttcctgtacctttagcctaccatattgccaaaaacaaaaggttaaggttccttaaccttaaggtagaaaaaataaaataaagtaacactttacagcatagtagaaaaggcagagtctgtagtgataatttaaaa

SEQ ID NO: 59051 - DNA, 425 bp, Homo sapiens
ttccagcaagttttcagcagactcagtgaccttttcctaagaccctctgcaatccatggggtgcttggtagaaatttgtacctccatgcttgtcaaactacagccattcagtgaatataatggatggtacaataaaataaattatttaaatagtagtaatagaacaaaaagcactgtatgtttttggggatacaatatcattgctggaataagcaattccttgagcagtaactaatgctaatgggaagacactatggctgcatgtcattctcggagttactctgattctgaggttcaaagctactattgtacaatctgggacttttactggtctgcaagtcttagtcttcagggtacctacactcagaaatcaagtaacctccttttgtctctgttagaactttctcatgcaagcttagtatgtt

SEQ ID NO: 59052 - DNA, 404 bp, Homo sapiens
catgatacgatgctctccatctgtgtaatcaagttattgatgataaaatgtgacactatagtaagtaatacattacaaataaatagtaatgtgtttatatatctctctctgattttaattgccttaaaattaagaattatattttatttgtgttcccaaagtctagcatactatttgcaatgtgagtaaaatattcgaaaactaattccaacaataattttctaatattctgtatgaaaaactggagaagcaaaagtttcttcaattcagagtctgataacaattctaggcttgatgtcatggagtgggtgtagaattgcctacatattggctgcaagaacctgagcacttcagctgttgtgggcatcagacagcttaagtgggcaaaactcaaaagtactagt

SEQ ID NO: 59053 - DNA, 555 bp, Homo sapiens
aaagtgctgggactacaggcgtgagccactgcatccggcctaggtggggttttgtccccgttctgcaggagggagactgaggctcggaggttcagggcctgcttggctgtacccagccccagtatatgccttggccacactagtcagatccttcccctcccactcctgccaccctgctcctgccctgtcccataatccaggttgaatgggggtggggatttggggagcaaggagggctcaaagagatggagataggcctgttgtcaggccaaagtgcaggttgggcactgggagtggggccaaccatagagcccccacccctgccagggtgtgggctgctcgaggaagacaggagtggcctggggcatgtgtgagattggcctgtggcctcaccctgtgggtggcaccagctctggccatggctttcccctttgccccaattcctggctcttctgaagccagatttggccgagggccctcactgggtactgagacagttccagaaaggactctagagccagccgagtccctccactctgcttccatccaagttct

SEQ ID NO: 59054 - DNA, 540 bp, Homo sapiens
tccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggactcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgc

SEQ ID NO: 59055 - DNA, 1038 bp, Homo sapiens
aaggtaggcataaaccaggaccgggaccccaagagcttaagattcggtctcaatagaatatattcaagctgatttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcgcggcgccaacataaaatcttactgccgtcgtgagtagaacaacaagatgatagccacctcccccccttttttgatggaaaagagcagcggcaccacatcattatgtgctgagtatttattaatattaatcaagctgggacgtggctctttttataaaaacaaattcggtgccagcaggagaaaacaatatatagctatgttttttttaggaagaaaaacacacttctgtgtgggcgagatatatcatcgcgcaacatc

SEQ ID NO: 59056 - DNA, 696 bp, Homo sapiens
acaggagctgagtcactcatcattgctctctcatttgcttctaacgactgaaacctctgttgctcccagaagacaagatttatttattttccatttaaagttagaattgggttgtaaaagcaatgtatgctgagtagagccatcctcaaaccaaggggagtgtttgactcaggcacaaacaaccacaagcttctgagtttggcagtcagaagtcaggtgcagcctgccccgaggggtgccagctggaactgttggcgcctgtgactctcctgggtccccaccagccctcaccgagtgctggagccactagagcagcagcctcagcagccctgctgacagctacaacgagggtgtcaaggtgggcatctgagcctgtgcagcaccttctgcttgcaggatttgtggtgtcccctagttctcagttgatgtgttcatgtcatagagtggagttggtgctgaaaatagaacagtgcagagtggaactgcagtgagacccaggagtcaattggtctggttctgaacccctctgagagtcagggaaaagctttatgcaaacattttcttttccattttcctctcagtgtaatagattttaggaattcagtcagattctgattttctacatacatcttcctctgatcagacagaatgttttctttagaacaaagtgccaagattgtttctggttttaaaaat

SEQ ID NO: 59057 - DNA, 745 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtgcaagtaagatacaaaccttgctttggtgtgatgcacaccttgatttcttttgcgtttttaaaaacatgcacaagattacaaatgtatatgttcaattttcacactgcttgtccattacaatctggtataaataaaatcgttagtaattattaccgattgatcttcttctagacctctagtctagctttgggtatac

SEQ ID NO: 59058 - DNA, 652 bp, Homo sapiens
cttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtaagtacgtttttccatgagacatctttaatgtttatttaggttaaaatgtaatggcatgtatgaaaaaagatagtgtaataatttttatttaacttatcggggacttttcatattacagaaatgctatttttaattataagatttattagttaatatgtgactgaccagcgttctaattgttgtaaagtttcttagaaaaataatgactggatcatattttagtcat

SEQ ID NO: 59059 - DNA, 227 bp, Homo sapiens
aggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttgg

SEQ ID NO: 59060 - DNA, 4502 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59061 - DNA, 3718 bp, Homo sapiens
ccggtgtgaaggccatgagtgattactgggttgttggaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccattacacatctttgcactggaattggtgcagatatataagtgatcctaatgttgatgcctgcccagaccccaggaatgcagagttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59062 - DNA, 4848 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgatgcagtgtgggaaaacagtcttgtaattgaactcatttgctactttggcaagacagctaaatccgtataagccatattctgtcagaaagccgcaagtaatgcctgatatttttatcctggggttgcgggtatctcagtgaagaagaaagccatctgtgctacttggaatagaggtaaagtgcaggttctccagcactgggtgggccagtgcaggtaccagtctgtaaggtgtgcgtgtgtggagaggaatgcagttcttcccaaggcagccaaccttcatttatcatcactggaatttttttgaaacgggggaactttcaactcttcttattcagaggacaattgtgttaaaaaggaaggaatttaatacagaatctgtcaaaaattttcaaatcaaaaatgaaattgttttgattttgttttaatttcttcagaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59063 - DNA, 4546 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatccttaaaaaagcgacgcagcaccgcaca

SEQ ID NO: 59064 - DNA, 4448 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatatgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59065 - DNA, 2300 bp, Homo sapiens
ccatctactgttagccacctggtgtccttagattaactcagggtggggtctagtgtgtgctactctggggttgtcagctcccctaagacaatgtgttgtctctctagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59066 - DNA, 2477 bp, Homo sapiens
ccaccccagcctcccaaagtgctgggattacaggcatgagctaccatgccctgcccaagatatactcttaagttttcttctaagaatcttagtttttaacttttacatttagacctgtacctgtaattcattttgagttaatttttgtgcatgtgggaggaagaggtcagacttcagtttttcacatgtagctatccagttgccacagcatcatttgttgaaaagactgttctttccctattgaaatgtcttagcatctttttatcattcttttcaagtaagctctattaggaaaatgtctttttcgattcataaagtacaggtttgtcaaaatcaaaaggttcattcatatgatgctctcttgattttacagcccagcagaccgggttatcccagtccgaggtccagcgaaggattttatcccagcccacagcacatggtaatgattggttgtaccatgtgctgtgggctgggataaaccaagtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59067 - DNA, 1774 bp, Homo sapiens
  misc_feature (20)..(20): n is a, c, g, or t
cccgttcactttctacgcancgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59068 - DNA, 2181 bp, Homo sapiens
agcgtaggcccaggtgctttccagcagtcagcacagagctggctgaaaaccggggtccttgagccagagaggctccctagcgacacccactgctgcctttgacttcagtcacgacctgcaaacagatggctatccccttaaagtgcattcatatgtcagctttttataattgtacaaagaacatgtttccattaggcggctgagggcagctaagctgagccataccgttttcactgcagaattcaaactaagtggaaatccttatagtcttcatgtagaatgtttgactctttagccaaataggtaattttgtctaaaattcagtaaattcccagatggattattatcttgtggtaaatgattttggggtgaggggacattgaatcaggtctctgaaagaatctggggtttttagtataatatgtatgattccatctcatttcctttaactgagctcaaagttagaaagaaaatactgcctaatttgtcacttggaggaattactttactgtcattctcaatctgaactatatcccgcacacacaagaaaatcaatgaccttctgcaatctgctttgatctcttgtaaagaccctctctagcttgattgtggtgatctcacgccatctgctggagagcagaaaaatgactggcttctgtgttgtcagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59069 - DNA, 4367 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59070 - DNA, 2114 bp, Homo sapiens
ttgagctcaagccgtcagcctgcctccgccgcccaaagtgctgaaattgtacaggagtgagccactgcgccctgccaccatccttaaaccattttttgtatagccgaggaaggtcttgaaatagagttggcatagtagaaagcataagaccagaagtcagaactgaggcttttgtcctggcttggagattaaagagctgtgtggccttcagcacatcttactgtatctcagttgtccactctaatgtgaaagtgtttggaatagatgatctctgaagttctgtcagattctgtggttctattatgaaacaaaagccctgccagtcactgagattaataaagtctaaacagcgcaaatggagacgaagttagtcatggtgtcagggaaggctttgaatggaaggaacaagatgctggatctgcatgtgtgaatcggcatgcacaaacaggcacactataatagctgaatttctaaagtaagtaaaaaaaatgtttaaatgcatgaatgtagtgtgggaagttaaaataagaaaaaaaaaatttaaagattgatttttacatcctattgctcctaaggaagatttatttacaggaaataaagttttcttctcatggaggcactgaaagaaaggctcataaaaattccctgaaaagttcattggtgcagggcttggtggcatgtgcctgtgttcccagctagtgggaaggctgaggcaggaagattccttgagcccaggagtttgaggcaagcttggacaacacagtaagaacatctctctaaaaaagaaaaaaaaaaatcactgaaaacagttctcctgacctatctcttgtctttcagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59071 - DNA, 3680 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcgtcatcggggtcctctaggtcgccgcaa

SEQ ID NO: 59072 - DNA, 2726 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctggtaattgtgtttctgaaaggcttctttgactttttaa

SEQ ID NO: 59073 - DNA, 475 bp, Homo sapiens
aaaaggtaccctacctaaatggctgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59074 - DNA, 768 bp, Homo sapiens
ggccttttaataatttttttttaacaaatatttattctgtaaatcaggtcctactctgggtatggggagagacagctattattttagtggattaggtctctattctcctcagactccttccgcatataacatatcaagagagagtataggacatttgatataaacaacatatcacattgtaattggtagatttcaagtattatacacaaaaaattattttgttcttttaacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtaagtacgtttttccatgagacatctttaatgtttatttaggttaaaatgtaatggcatgtatgaaaaaagatagtgtaataatttttatttaacttatcggggacttttcatattacagaaatgctatttttaattataagatttattagttaatatgtgactgaccagcgttctaattgttgtaaagtttcttagaaaaataatgactggatcatattttagtcataaaataccattgacttatttttcccttctaggttttttttttttttaactcttggatgagtactaggcaacaatgcaac

SEQ ID NO: 59075 - DNA, 4413 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59076 - DNA, 4665 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaaaaaccagcacaagacacacaaactttggggcgcgcgggcccaaaaagtttcaaccccggttgggcccgggcccatggttggcaatgcgcccggtcaaggaccgggcaacagggggtcccccaaaacgcgggccgctccaaacagggtgggcggcaacggcggc

SEQ ID NO: 59077 - DNA, 4873 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcgcggcgccaacataaaatcttactgccgtcgtgagtagaacaacaagatgatagccacctcccccccttttttgatggaaaagagcagcggcaccacatcattatgtgctgagtatttattaatattaatcaagctgggacgtggctctttttataaaaacaaattcggtgccagcaggagaaaacaatatatagctatgttttttttaggaagaaaaacacacttctgtgtgggcgagatatatcatcgcgcaacatc

SEQ ID NO: 59078 - DNA, 2443 bp, Homo sapiens
attattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59079 - DNA, 2422 bp, Homo sapiens
gacctagtgttcccgacgtgctggctgccctttacggtttgggtccaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59080 - DNA, 4311 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59081 - DNA, 4436 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtaatgattggttgtaccatgtgctgtgggctgggataaaccaagtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59082 - DNA, 2646 bp, Homo sapiens
attattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgataaagcactggttaagctgaacgataggaagattgtattgagcaatttagggagattattggccagattgctaattgatcacgtaagtgctggcgtgatcacattaggtgtgaaaagaatctgtcctcagacatgtatatgcttgataaagtgctgcgtgggatttctcagaggaattctgttctgctcaagataaactttgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59083 - DNA, 4367 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaattactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59084 - DNA, 2171 bp, Homo sapiens
catcgcagccagccccaccagaggagtatgtccctatggtgaaggaagtcggcttgtccctgaggacattatgggacactgtggatgagaccattcccctcctaccagccagcacccaccgagagattgagatggcacagaagctattgaactctgacctgggtgagctcatcaacaagatgaaactggcccagcagtatgtcatgaccagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59085 - DNA, 2261 bp, Homo sapiens
ataaaggcacgtagcctacttcgtttattctgatattggtgaaatttccgtactattatttacgtaaaatctagatttctctgtttggtttctatattctagatgcagtgtgggaaaacagtcttgtaattgaactcatttgctactttggcaagacagctaaatccgtataagccatattctgtcagaaagccgcaagtaatgcctgatatttttatcctggggttgcgggtatctcagtgaagaagaaagccatctgtgctacttggaatagaggtaaagtgcaggttctccagcactgggtgggccagtgcaggtaccagtctgtaaggtgtgcgtgtgtggagaggaatgcagttcttcccaaggcagccaaccttcatttatcatcactggaatttttttgaaacgggggaactttcaactcttcttattcagaggacaattgtgttaaaaaggaaggaatttaatacagaatctgtcaaaaattttcaaatcaaaaatgaaattgttttgattttgttttaatttcttcagaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 59086 - DNA, 3237 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaaggtgggcatctgagcctgtgcagcaccttctgcttgcaggatttgtggtgtcccctagttctcagttgatgtgttcatgtcatagagtggagttggtgctgaaaatagaacagtgcagagtggaactgcagtgagacccaggagtcaattggtctggttctgaacccctctgagagtcagggaaaagctttatgcaaacattttcttttccattttcctctcagtgtaatagattttaggaattcagtcagattctgattttctacatacatcttcctctgatcagacagaatgttttctttagaacaaagtgccaagattgtttctggttttaaaaat

SEQ ID NO: 59087 - DNA, 2533 bp, Homo sapiens
agcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtatgccagtcattacagatataaactgtgttattttattatttagcgcttttggggtagagcggtacattgtgcatatttttatttatgtacttatgagtatgatttggccga

SEQ ID NO: 59088 - DNA, 497 bp, Homo sapiens
tgtatttttagtagagatgtgatttcactatgttgcccaggctggtcttgaactcctgatctcaagtgatccacctgcctcggcctcccaaagtgctgggattacagatgtgagccactgcagctgccctctagatttttttttttgaccattgcttatttggtttgactttcattttcttccccattgtggtagcccttttctgaatgtctgttagtttgtctgtctctctcctctgtagtccctagagtcagatgaactcctctgcaggtgcaatggtgtaacactctctagtgctgaattttgagcaggagaaagagagcaagagtgaccagcactcttggaaactctggcctcttgagaatttggtgtcttctctgcaaaggctgcaaacctgttaacccacaggccagagagagagagaagccagaagcatgatctgttaagcttgagtttcatatttgatgcacagagatcactgttttttgatgagaatt

SEQ ID NO: 59089 - DNA, 459 bp, Homo sapiens
cagaattaagatacattataactaagatataagtatttcaaaatttaaacatttaaaataatttttaataaagaataaagtagaaaacttacaaacccatgtctatttgaaggattagctattatgtgttttgtaagcgagtagataaaaggagtaactaacttgtagttttacttgtttttagtatgcatattatagaatgtttgcatgtaaaattaatacaatttgactttgacaaacatttcggataactggaaagatggaagcaaaagcttcatttgggatgaaatgtcagtttattaaaatttctaggccatgataatttaagagtttgggaaaaaaccaaaagaacaggtataaagatagttgtgcatttggttagaaataagcggtgacgtattttgacaaagagaagcatactaattgaatacagtgggcaggactcattagagactgtga

SEQ ID NO: 59090 - DNA, 1591 bp, Homo sapiens
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggaggcggaggttgcagtgaaccaagagatggcgccagtgcactccaccctgggtgacagagagactctttcttttt

SEQ ID NO: 59091 - DNA, 1490 bp, Homo sapiens
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59092 - DNA, 1268 bp, Homo sapiens
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59093 - DNA, 1454 bp, Homo sapiens
ggcacagatcttggaacgagacgacctgccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59094 - DNA, 1520 bp, Homo sapiens
ggcacagatcttggaacgagacgacctgccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59095 - DNA, 1455 bp, Homo sapiens
  misc_feature (1043)..(1044): n is a, c, g, or t
  misc_feature (1063)..(1063): n is a, c, g, or t
  misc_feature (1066)..(1066): n is a, c, g, or t
  misc_feature (1185)..(1185): n is a, c, g, or t
  misc_feature (1312)..(1312): n is a, c, g, or t
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagtctccagacagggttcattgaaaacttagtctgtggagaaccagaagggctaactcagtttgtttcattttatttatttcattttattttccgggatagagtcttgctctttcgccaaggctggagtgcagtggcacgatctcgactcactgcaaccttcgcctcccaggttcnngcaattctcctgcctcagntcntgagtagctgggaccaccacagtttcaccatgttggccaggctggtctcgaactcccgacctcagtgatccacctgcctcggcctcccaaagtgctggattacaggcgtgagccaccgngcctggccaggctgcacacattcttattagattccaccttgttctggtgttgtagagatgtgattaggtatttagtgaattcaccaagtgaggagagaatgaaaagaaaacacaacctgcctggccnggcgtggtggcgtgagcctgtcgtcccagctactcaggaggctgaggcaggagaatcacttgaacccaggaggcagctgttgcagtgagccaagatcacgccattgcactccagcctgggttgacagaacgagactccacctc

SEQ ID NO: 59096 - DNA, 1229 bp, Homo sapiens
ggcacagatcttggaacgagacgacctgccgtgtcagcacgatggaccccaaacagaccaccctcctgtgtcttggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59097 - DNA, 1095 bp, Homo sapiens
ggcacagatcttggaacgagacgacctgccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagtctccagacagggttcattgaaaacttagtctgtggagaaccagaagggctaactcagtttgtttcattttatttatttcattttattttccgggatagagtcttgctctttcgccaaggctggagtgcagtggcacgatctcgactcactgcaaccttcgcctcccaggagaatcacttgaacccaggaggcagctgttgcagtgagccaagatcacgccattgcactccagcctgggttgacagaacgagactccacctc

SEQ ID NO: 59098 - DNA, 1345 bp, Homo sapiens
ggcacagatcttggaacgagacgacctgccgtgtcagcacgatggaccccaaacagaccaccctcctgtgtcttgtgctctgtctgggccagaggattcaggcacaggaagggaggtatattagcgagcatttttggtgtagaagtttgggctgcaatccggtaaatgatgcttcagcacaacggccagggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59099 - DNA, 1567 bp, Homo sapiens
ggcacagatcttggaacgagacgacctgccgtgtcagcacgatggaccccaaacagaccaccctcctgtgtcttgtgctctgtctgggccagaggattcaggcacaggaagggaggtatattagcgagcatttttggtgtagaagtttgggctgcaatccggtaaatgatgcttcagcacaacggccagggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59100 - DNA, 1309 bp, Homo sapiens
ggcacagatcttggaacgagacgacctgccgtgtcagcacgatggaccccaaacagaccaccctcctgtgtcttgggaggtatattagcgagcatttttggtgtagaagtttgggctgcaatccggtaaatgatgcttcagcacaacggccagggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59101 - DNA, 1232 bp, Homo sapiens
ggcacagatcttggaacgagacgacctgccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctggacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaact

SEQ ID NO: 59102 - DNA, 661 bp, Homo sapiens
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaagatccatccaagggaatcacaggactcgatttggcagatatgaaaggcatgggaaagtccccttcctgtgcctgaatctctctggcccacacagagcacaagacacaggtgggctgtctgtttggggtccatctgtgtgt

SEQ ID NO: 59103 - DNA, 571 bp, Homo sapiens
ggcacagatcttggaacgagacgacctgccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaagctctgtcttgctctagcgccaaagttgtgaccagccgtgcgctcgttccg

SEQ ID NO: 59104 - DNA, 402 bp, Homo sapiens
aagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttag

SEQ ID NO: 59105 - DNA, 506 bp, Homo sapiens
aggcgctcaagtccatcaggagggaaccagcccatccacgtggaggtgttgaagagtcaggagcccgcgcacaggaggctgcctgggtttgaatcctggcaagttttaaactcactaagcctcagttattccatctgcaacagaacctgcctccctgggattgctgggaagattcagggagaaaacttgggtcaagccattggctcccaaataagcaaatcctccacaggggaagtccccaggctcgggctggagcccagggaggtgcggaccccaggggaggtcagaggcaaccctcacacaggactgttccacgttctgtttctgtaacgcgggggccttcgcgcccgtctgcctgtgcacctgcgaactaattctgagcaactgtgcgctccctggcactttctgaagtcaaaatctgaacatttccaagtttaaatagttgcaaagagtatgatttccaaaatcatgtcaatattgccatcctaaaataaaagtgtgacatc

SEQ ID NO: 59106 - DNA, 904 bp, Homo sapiens
gtggaaaaatgcaataatatgttaatatagtatggtagtttgagagaatcaggtaggtgctactagacacattgaaactagaataggtttataaactgttcatatctttcaatgcataatctttagaaagactccacaaagcaaaattcatcctgttagtacaaaatggaaaggttcttattacagaagtaagttgtacaaactgcatcatcaattactatgtaaagcctaatttcaggatgcacttacaaaattgctactcttcatcgatgccgtatttacatccctcttcatttcatctatattctacttggctccaacaactaaattgttgcctaaataactcaatcattatttatagcactgtaaaattagaaatccaaaattggttgcatttcatgatttttgactcttttaacccttcagagtaatataaaatctcattagaactcttataaaaccagttagctaaaacaactagattattatactagttataaatgctggtatattataatttgtgggatctaattaaatgtttgcctattaaatatagtttgatttaaatgagacaccatgttctgaactggagaaaacaatatcaatgaagtcatattttcatacctttaaaaattatttaattttcaaccaaacaaaaaataaattgtaaaaattatgctcatttctattccaacaagtcagaaaataatgacataatatttctaaatgagaatgatgtcaatttcattgtctggaacatgcacacttgtgtgcacatagagtcaatttctgtctcttctaagtgagcacagtaggtagggaactcaatggaagcagtgtgcacacacacacacccttagtagaatatggagcattattctttaccaaaagtagctattctctg

SEQ ID NO: 59107 - DNA, 184 bp, Homo sapiens
atgatatctagactaccagtattttttgaatgaggctttcttaggagtatgttgatgcactctcatcctttcctccctggactcctaccacaaccctctgactgtggaatagcatggttgtgtgtaaggctggagcacaggcacagtgagatgaggatgagggattgagggatgctataagcca

SEQ ID NO: 59108 - DNA, 645 bp, Homo sapiens
ttttcaggaaatgggcctcacctcttttcttcctgtcaccctggtagttttgagtcaatgctgagcatacatgcagttttatcttgcgccccacattactttgcatatggcctcaaatgtcccttattttacactggtctttgatatatttatggtgtacatacatatcagaaactttttttttaatcacaattccttatggacttaattatcacattatgacatgaaattaccaattttaggtctcttttttccctaggcgtgttgaggatcactagagtaacatcttggaaggtgccaagtagtagagttttatggactgagtttattcttaccagggtgttgcaaagaccttactcctggattgcaactatcttaccatttcccagcattccctcttgactttcttttttgcagatcctgtacctcattcctcttctccttactttcgttaacattctgttaccataagtgcatttttaaaataccaacctttcaccatccatccacagccaattttagtcagtagtcatagagggataatgagtctctaatgtcatgacagttacacatttctaaatgtagcatgaaatagttggaaagtagtatcttattaggcaaacagaagtgatagtttttggatgt

SEQ ID NO: 59109 - DNA, 544 bp, Homo sapiens
gtggagcagtcagaacacacacaacatttattaagtctgaagtcttatatgggcatggcttgtggcaccccaaaaataataacaatagtaacaaagatcacgggacacagatcagttaacagagagagtaatgaaaaaaattcaaaataatgtgagaattaccaaaatgtgacacagagacatgaagcaagcacaagccgacggaaaaatggtgccaatagtctcgctcgaagcagggttgccacaaaccttccatgtgttgaagatgaagatgcagtaaaatgaggcatgcctgtgcccacacacctggcctgtgaagtctcctgactcagtcacttcagagacaaacatgggggcctgttacaatcctcattttcttataaacaaaacaatcatgatttgcctggagaagagaaaggaaactaaccttactgattgccaagagctacatactaggcttttttcttcatgttgtctactttaatcctaatttagcattatctttttatttttagaaagtaagaaaatatgattgactgctttg

SEQ ID NO: 59110 - DNA, 496 bp, Homo sapiens
tcgattaccaacttgtgctgattttatcttcaaatactctccagaattgtcgctgtcatggactgaatatttgtgttcccccaaattcatatgtcctaatccctgatgtgactgtatttagagacgtgacctctaaggagtaattaaggttcagtgaggtcaaaggtggagccctgatctgataggatcagtgtccttataagaagagactagagctgggcacaggggctcacacctgtaatcccagtattttgggaggctgaggtgggaagatcactcaaggagaggagtctgagaccagcctgggcaacagagtgagactccatctctacaagaaaataaaatagtcagacacagtggtacacacctgtggtcccagctcctcaggaggctgaggcaggaggatggcttgagcccaggaatttgaggctgcagcaagctatgatcacacctctgcactccagcctgggtgacagcatgagacccagtctcttta

SEQ ID NO: 59111 - DNA, 324 bp, Homo sapiens
ttgaaggaagcttagaatgtatttgaactgaattaaggcaaaagcaactcgcttttcaagatttttttttttcctaagtagcaaagtaaacaaagctgcactgaggccagatgtgctttctggttgtgaatatttgtactctagaacctcattctggtatgaatcagcagagtggaatctagtatggacacaggctgtctcaaattccatccactggatatgagtggccaagaaagcagtcggacccatactgctggtgctgtagcaaggttcgggtggttcctctgcagcctcaggtctctcccactgcggcctccatgtgtt

SEQ ID NO: 59112 - DNA, 438 bp, Homo sapiens
tcaaaccctggttgaccgtgggtaactgaaactgcagaaatggaaaccgtggataaggggggactattgtaatagcaaatggttgctgacagaggaagaggtgtaatgtaaaagaagtttctttttctcctctcttcttaatccatagcaatggagagtgaaaggagaatcacttctatttccatttcaattgtatcaattctccctggtgagaatttgcataatggttggggatttcattaaagatatctccctaggaaactagatagctatggattttgatgacttctattaccaaagagagattctgttctcaggcccaatttcaggggcagaggatgatgaggggctgaacacaggcttttaagaaatcaattcaggagtctttatagattgatcagaatcccaatagtttattgatttttactctgaaataat

SEQ ID NO: 59113 - DNA, 530 bp, Homo sapiens
cccatctcagggaaaaaacaagaaatgctgtaactttatatttcatcgtattgcactctaattttcaaaagcttgacaatgcattcatttataggcgtctactattttaactagaatttcagaacatttaaagtaggcatgagctgtgcgttaaatgtttctgaggtgtgaatttacaaaagtagcttatattagtggagctgtagaatattgttttttctccaggaagccaccaggaaccatatattgtgtgctggagcttgtggctctttccgagctcacagtgttgacagctgatgcatttcagtgcgtgtaacatcccgtgtttctcagctggctcaatcgcatgtcagtttcttctgatttgtgtaatggattagtgagaataacctcatgaagcatctgcatgttgaatcttaatgcacaaaggcccatgtagcaggcagtatgttcctcaacagctgactgagggctccaaggaagctttactgacaccatgactaggtttgtcgtggctcgtaccctttgaa

SEQ ID NO: 59114 - DNA, 445 bp, Homo sapiens
tgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggccaacacgtgtggatcgcctgagggcaggagtttgagaccatcctggccaacatggtaaaaccccatctctactaaaaatacaaaaattagccaggtgtggtgtcgagcgtctgtaatctcagctactcaggaggctgaggcaggagaatcgcttgatcccaggaggtggaggttgcagtgagctgagattgcgccactgcactcagcctgggcaacaagagtgagactccatctc

SEQ ID NO: 59115 - DNA, 274 bp, Homo sapiens
caacctctgcctcccgagttcaagcgattctcctgcctcccgagtaggtgggattacaggcatgatccatcacgcccaactaattttgtatttttagtagagatggggtttctccgtgttggtcaggctggtctcgagctctcgacctcaggtgattcacccacctcggcctcccaaagtgttgggattacaggtgtgagccaccgcgccaggctactggtctcaattcttttggatacccagaagcagaaatgctggatcacatggtagtctc

SEQ ID NO: 59116 - DNA, 524 bp, Homo sapiens
ttcaaggctgggcatcagggaacagaggaatacctatttgccaaatggaagtagttgaaatcaggatggaaggaaaataattttatttttatggtcttaagagggctttataaacaatgaaggttttaattaaaacaaaaaaccattcaataaacgtgtctggggatatccgcctaagagttatgtgacccaggggacgtggtctgtgggttagatatgagtttaactaggtatgttttagagtcattgatagactctgattatcaagaaaggaaacatcctgccaagcccgtcctttccttacttccctatctccattgtccctaaggaggggggccggagagccagggatgaagtaggcaggtactggaaaattactatttttgttgccaagtatattatatacaaaaataggttaaccttttctgggagggcatggccctgacacatttccttctggtattctagaaatgtgtctttcctcttcttctggcagccttcagcaacttaagttttgaggattt

SEQ ID NO: 59117 - DNA, 410 bp, Homo sapiens
agatattctcattgttaatgagaaggacctacacttgcagtttgcagatgctgccaccaatgtttaggagccatgactacaaagcagagagctaaaatttaatcatgcttccagttaccttccccagggctcagaagaagcaagaagcagagtcacaaatgggaatccaggagatcatataaaggcacactggggtaaggcatgctgaagcatgagagaaataaatttccttgaggttataaaaagactggactacagtggtagctttgagttttggcagttctcttctgcaccttacaaaacaggaatggaagaaatttgctagctggttacccttgctctgcccagatgtaaataagtcagtgaaggtagtaacgatactgtggttacaaaccaggaatcagacagcc

SEQ ID NO: 59118 - DNA, 496 bp, Homo sapiens
ctaatcctcaagacaactatgagactgatactactattatacccattttaaagattagaaacctaggcacagagaagctcattaaattgttgagcattacagacatgacaggaggggccctgaacacaaacccagggtaccagaaagagatcctgaaactggtgatggcttctgagacctactagatgagttggaaacccggaggctggatattacaagggcactcagggcagggagaagagagggaagagagagcagggaggagcagacacagctgacatggctgggggagaaccccaccccattgaagctcaggtacacggggcctactgaagtctgtgagcaaacttacttgcccacagggtgggcaggattgccgagggccagcccaattccaggccatcaggtgtgcagaccccgctgaaggactgcagaaaacatggaaaggaactctgctggactccgggcctccaaatgagtaccagacagcaaatgt

SEQ ID NO: 59119 - DNA, 4679 bp, Homo sapiens
  misc_feature (143)..(144): n is a, c, g, or t
agcggggggggggatggagaggggaggggggagcggagccgagcggagacagccgcggcgctgcagagcggctggggcggcggcgcggctcccggtgctccccccggcgcgcgccccgagtcggtgagggcccggctctgcgnnccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacgcactgtgagcactcacgttctcaacctgtgccccagttttccagagcactggggatatatccctccttgggactcttggctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagccgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcaaaaaaaaaaaattctcctaaacttacccaactactatcctttctaaccctacctctctaatctctctaatttctccttattatatatctccctcccctaaaaaattcaatggccggcttttaaccccgttctgacttggcccttgggtgtccccaaccttaacgcccttgtgagcacaatcccctttttccccgcgttggttcaccggggcg

SEQ ID NO: 59120 - DNA, 4599 bp, Homo sapiens
  misc_feature (143)..(144): n is a, c, g, or t
agcggggggggggatggagaggggaggggggagcggagccgagcggagacagccgcggcgctgcagagcggctggggcggcggcgcggctcccggtgctccccccggcgcgcgccccgagtcggtgagggcccggctctgcgnnccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagccgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcaaaaaaaaaaaattctcctaaacttacccaactactatcctttctaaccctacctctctaatctctctaatttctccttattatatatctccctcccctaaaaaattcaatggccggcttttaaccccgttctgacttggcccttgggtgtccccaaccttaacgcccttgtgagcacaatcccctttttccccgcgttggttcaccggggcg

SEQ ID NO: 59121 - DNA, 4297 bp, Homo sapiens
gtggttgatctagcaggatcttatgtcatccccttcgtgtgtcagtccccgtttcgcggaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagccgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcaaaaaaaaaaaattctcctaaacttacccaactactatcctttctaaccctacctctctaatctctctaatttctccttattatatatctccctcccctaaaaaattcaatggccggcttttaaccccgttctgacttggcccttgggtgtccccaaccttaacgcccttgtgagcacaatcccctttttccccgcgttggttcaccggggcg

SEQ ID NO: 59122 - DNA, 1902 bp, Homo sapiens
tgcaggctggtaccgtctgggagtatgggatccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcaaaaaaaaaaaattctcctaaacttacccaactactatcctttctaaccctacctctctaatctctctaatttctccttattatatatctccctcccctaaaaaattcaatggccggcttttaaccccgttctgacttggcccttgggtgtccccaaccttaacgcccttgtgagcacaatcccctttttccccgcgttggttcaccggggcg

SEQ ID NO: 59123 - DNA, 4168 bp, Homo sapiens
  misc_feature (143)..(144): n is a, c, g, or t
  misc_feature (4048)..(4048): n is a, c, g, or t
agcggggggggggatggagaggggaggggggagcggagccgagcggagacagccgcggcgctgcagagcggctggggcggcggcgcggctcccggtgctccccccggcgcgcgccccgagtcggtgagggcccggctctgcgnnccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagccgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaatccaatctcaaaaaaaaaagttaaaaaaaaaaaaaaggggggggaaagaaccgggggggcacttgggccgtttgtgaagggcgaaagagataanaagagggcgggtaaaacggggaaaggtgggttgggacccttggggaggacccaagaagcggataatgttggacgttggtgtattgagatacaaagacgggaggatcaggtagctccaaga

SEQ ID NO: 59124 - DNA, 2571 bp, Homo sapiens
aataaggggagacagccctcatgctccccctgctgttggcgacacctgcatcctgcgtggtgtatccaagatgggtgtccccacaccctcctcaggctcccggagcagggatggaagaaagctgaaaggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcaaaaaaaaaaaattctcctaaacttacccaactactatcctttctaaccctacctctctaatctctctaatttctccttattatatatctccctcccctaaaaaattcaatggccggcttttaaccccgttctgacttggcccttgggtgtccccaaccttaacgcccttgtgagcacaatcccctttttccccgcgttggttcaccggggcg

SEQ ID NO: 59125 - DNA, 722 bp, Homo sapiens
cacacccagcggcagccgttgactccctccacccttgcttccctctcaaccatctcacctccatctgtccagtggagccagatgtcccaccttcttgggagaaattaattgaggctcatttccaggacagaggggcaagctgggtctgaggagccaagcagaaaaacttcccaaaatcactgggtggggaggggtcagagacttactgctgccccagctgttctgactctgcccccagcttttggccccacccttttaaagcaccttcagaggttcccaatggtgacagtaaacaagtctccactgtcctggccatctctgctgtgttcaccctactcctgatctttctggctgctcagggactgacagccaagatgtgaggctgtgatgagcaggaacagggaggcctggagcccccaggtgagtggagtggcttggctttagggaagagcagcctaggtaagtggatatggatggaagaggctctgaaatttgggatctgaacttggggatcaaggcagcagttctttctttataggaacttcctattaaaaaacatttttttaatttttttaataaaaacaggaaagagccttataggaaagggctcagtactgtagcccaggctctcaaaaattatcagtataacttaaggtttctatgcccagttacttttcctattttagtataataaaataaaatatctgactcactagaggaaa

SEQ ID NO: 59126 - DNA, 604 bp, Homo sapiens
cacacccagcggcagccgttgactccctccacccttgcttccctctcaaccatctcacctccatctgtccagtggagccagatgtcccaccttcttgggagaaattaattgaggctcatttccaggacagaggggcaagctgggtctgaggagccaagcagaaaaacttcccaaaatcactgggtggggaggggtcagagacttactgctgccccagctgttctgactctgcccccagcttttggccccacccttttaaagcaccttcagaggttcccaatggtgacagtaaacaagtctccactgtcctggccatctctgctgtgttcaccctactcctgatctttctggctgctcagggactgacagccaagatgtgaggctgtgatgagcaggaacagggaggcctggagcccccagccattgtcatcacttccctgatctgcctaaattctgcccagcagtccgtgaaaatggtttgctgatgacatatgtaaggactttaactcccctcaagcaatctgctcatctcaaagggtaaaacattggctcactcctaatgcaataaatgacacataaggtcacaattcaatggtactctcct

SEQ ID NO: 59127 - DNA, 302 bp, Homo sapiens
gtaaatcgcttggaaactttttatatccatagcgggtaccactatagttcataagttatttttcacagtataaatgccaataatattgcataacagcaggaccatttgcctctttcactaggattaaaactgggtatgttaaaagtgcatgagagtattctagctaataaatgaagaagtcagagaaatggaatatcattttgtaacccccatgatttaatgggtatagtcaatggccattaacaggctgttaacttcacaaaaagagtcaaccagacattaggggacttctaatggaagta

SEQ ID NO: 59128 - DNA, 651 bp, Homo sapiens
tagggaaaaaacatgggttaaaaatgctggagagaagtttctccgcaagaagatcaaaaaggaatcggaagtgccctgttaagtttgatgacaccagcgatgatgaacaggaaagtggtgatgggtcagacaatttgaatcaagaaaattttgataaggaaaagtcagatagaaatgattctgaggaccctggaagtgaatataatgctgaagaagatgagctagaggaggagatgtcagatgagtactctgacattgaagaacaaagtgaaaaggatcataatgatgcagaagaagaacctgaggctggtgattctgtaggaaatgttcatgaggggttaactccagtggtcattcagaacagcaacaaaaaaatattgcagtgtcctaaatgtgataaaacatttgaccgaataggaaaatatgagagccacacccgtgttcacacaggtgagaagccctttgagtgtgatatttgtcaccagcgctattcaacaaagtctaacctaactgttcacagaaagaagcacagtaatgaaacagaatttcataagaaggagcacaagtgcccttattgtaataaacttcatgcaagcaagaagactttagccaagcatgttaagaggcaagtattatcttgcttccataata

SEQ ID NO: 59129 - DNA, 386 bp, Homo sapiens
gagaacaaagagaatggaggccacatacaatggagtaacagaagctttgcctgtagctcaagaaccaagccgagaatccacacctcctgattcacagttcagtattttcggccactttactcaaatatttttataaattatttttaaatcggcaaaatatttaaatttcatccattaaatttaaatttctagatgccctagtggcatccagaacacatattttggggaaaatattctaatttttttaaacagaaaaagctaggaacagatgatgcattaaaaagtagaacacagagctcttaatttagaatgatcaaaataggttgattcaactattaccttctcctaggattatgaatcaacccctagcagcagacaaagtcaca

SEQ ID NO: 59130 - DNA, 2176 bp, Homo sapiens
aatggactttggaacacaacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaaaccccacgatctgtccctgctcaaggaacgcaaacctcccttggcggaagccctgctcagcggaagccttgagaccttttctcaggtgctgatggagcagcaaagggaaaaggccttgagagagcaagagaggcttcgtctctacacagccgacccactggatcgggaagctcaggccaaaatagaagaggaaatccggcagcaaaacattgaagaaaacatgaatatagcgatagaagaggcccccgagagttttggacaagtgacgatgctctacattaactgcaaagtgaatgggcatcctttgaaggcttttgttgactcgggcgcccagatgaccattatgagccaggcttgtgccgagcgatgtaacatcatgaggctggtggaccgacggtgggctggggttgctaaaggagtgggcacacagagaattattggccgtgttcatctagctcagattcaaattgaaggtgatttcttacagtgctctttctccatacttgaggatcaacccatggatatgcttctaggcctagatatgctccggagacatcaatgttccatcgatttgaagaaaaatgtgctggtcatcggcaccactggcacgcagacttattttcttcctgagggagagttgcccttatgctctaggatggtaagtgggcaagatgagtcttcggacaaggaaattacacattcagtcatggattcaggacgaaaagagcattaaagcacgttataaatatgttaccaccttgagggagcctcaggtccccggcaattataagttaagagcttactggcaatgtaatcattaaaaaacatcagtaacaactaaacctggccttgggactacgttctcagatgggtaactaacgtcaatcctgattccttggtcttggtccctcttccatttcccttgtccagagatcactgaaaggcatcctgggaaggctctggaggctccagctgatttccagataatccatgaaaaagaaaaccagcttcttcctttagagacactatcctatcagattacaggtggcttatccaaatcattgctattttgcagaattccctggaaaaatgctatggctgcagaccttacaaggcatccacataaaactatttcacatcagcactaataattctttctactgagagaaatatgcccattttcacaggttttgttttctttgggaagggtattagaaatggtaggtcagttacactatgatgttaactaatacttatacatgtctgtttggggcagcataaagaccaatttcctcatatttacaccttcccttcccctggatcccctgcagtcaccctgcaatccacagctaaagactatttttgccatatttgagaaagtggatttatctccaaggatgctacattaattttctatttctcctgcattcaaagaaactctggctataaaacaaaggcaataaattagattttttaaa

SEQ ID NO: 59131 - DNA, 455 bp, Homo sapiens
aaactgcagtggggcattctctgatcctggctctctgctagcagcatggtactgtccttagacactagagggcactgtgtatacattcctgccaggaaagagcctttctaggaagaaggaagtagtactgctggaaatggtactgtgtagttgcatggacagaattcagagccctgtattctcgtggcagacccagagctctttcttctgcgccaagctgtgaaccaagcacaaagcacatatgggagatgaagcaagaggttgaagttgaagatatcatgaggacccttctaacttggtctctttaacatgctggtgtcctgtgcagctaatatggagttttggaaggggtggcagctgtgaattagtgaggaggatgaggtgggacattttaagagggcaccttgggggcaggggcaggcccactctatgaggagctcagctcaaaatctttt

SEQ ID NO: 59132 - DNA, 340 bp, Homo sapiens
  misc_feature (339)..(339): n is a, c, g, or t
catctgcaagcccctgcactacacaaccattatgcaacaagggatctgccaccttctggtggtgatagcctggattggaggcatcctgcatgccactgtgcagattcttttcatgaccgacttgcccttctgtggtcccaatgtcattgaccactttatgtgtgatctcttcccattgttgaaacttgcctgcagagacacctacagacttgggatgctggtggcagccaacagtggagccatgtgcttgctcatcttttccctgctcgtcatctcctacatagtcatcctgagctccctgaaatcctatagctctgaaggacagcacaaagccctctnc

SEQ ID NO: 59133 - DNA, 2968 bp, Homo sapiens
  misc_feature (955)..(955): n is a, c, g, or t
  misc_feature (1346)..(1346): n is a, c, g, or t
  misc_feature (1561)..(1561): n is a, c, g, or t
  misc_feature (1641)..(1641): n is a, c, g, or t
  misc_feature (1706)..(1706): n is a, c, g, or t
  misc_feature (1715)..(1715): n is a, c, g, or t
  misc_feature (1719)..(1719): n is a, c, g, or t
  misc_feature (1761)..(1762): n is a, c, g, or t
  misc_feature (1768)..(1768): n is a, c, g, or t
  misc_feature (2705)..(2705): n is a, c, g, or t
  misc_feature (2963)..(2963): n is a, c, g, or t
  misc_feature (2965)..(2968): n is a, c, g, or t
gaggaagacaggcagccggcgcacccgctcggcctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccatgcctggttggcctgtctctgacccataaccagctggagactgtcnctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcncgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctnggcagggctccctgggactgcagtacaatgctagtcaggagtgggacctgaggcgagctgcggttctctgcggctcaccntgtctatcgaggctcgggcagcagggccctagtagcagccatacaggagctggggaagggggctntggggctgnccangcgacaggtaggggcgaggggagctgagtctccgaagcttgnntttacntgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttggccctaccttgaacttggccctgcagagtctcttgtgaggagaatccacatcctataaaggaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctnaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaanannnn

SEQ ID NO: 59134 - DNA, 688 bp, Homo sapiens
  misc_feature (683)..(683): n is a, c, g, or t
  misc_feature (685)..(688): n is a, c, g, or t
gaggaagacaggcagccggcgcacccgctcggcctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaanannnn

SEQ ID NO: 59135 - DNA, 2914 bp, Homo sapiens
  misc_feature (955)..(955): n is a, c, g, or t
  misc_feature (1346)..(1346): n is a, c, g, or t
  misc_feature (1561)..(1561): n is a, c, g, or t
  misc_feature (1641)..(1641): n is a, c, g, or t
  misc_feature (1706)..(1706): n is a, c, g, or t
  misc_feature (1715)..(1715): n is a, c, g, or t
  misc_feature (1719)..(1719): n is a, c, g, or t
  misc_feature (1761)..(1762): n is a, c, g, or t
  misc_feature (1768)..(1768): n is a, c, g, or t
  misc_feature (2651)..(2651): n is a, c, g, or t
  misc_feature (2909)..(2909): n is a, c, g, or t
  misc_feature (2911)..(2914): n is a, c, g, or t
gaggaagacaggcagccggcgcacccgctcggcctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccatgcctggttggcctgtctctgacccataaccagctggagactgtcnctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcncgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctnggcagggctccctgggactgcagtacaatgctagtcaggagtgggacctgaggcgagctgcggttctctgcggctcaccntgtctatcgaggctcgggcagcagggccctagtagcagccatacaggagctggggaagggggctntggggctgnccangcgacaggtaggggcgaggggagctgagtctccgaagcttgnntttacntgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaatggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttggccctaccttgaacttggccctgcagagtctcttgtgaggagaatccacatcctataaaggaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctnaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaanannnn

SEQ ID NO: 59136 - DNA, 225 bp, Homo sapiens
gcatggcccctggactgaaggtgctcaggttagtaagggagtgtcatgcaggtcaacacatgtcgcacatggaccacaaatgcctgccaccagcaggatgcacggggacttctgggaggggagtggacaggatacttatctgtgactggaatgtaggtgagaggtggagaagagagtgaaggataacttatagagggggcagcatttgttttgggtcttgaaaga

SEQ ID NO: 59137 - DNA, 349 bp, Homo sapiens
ccattagtgggattgctggatcaaatggtagttctacttttagttcttcaagaactctccacactgttttccatagtggttgtactagtttacattcccaccagcagtgtagaagtgttccctgctcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatcc

SEQ ID NO: 59138 - DNA, 605 bp, Homo sapiens
cgcccccgggaactcgctggaaacgcgagttctcggccttcgcccagaccctccgaatcgaaactcctgcggcgcgcgctgccagcccgagggccccgccgtccaggggtcccctgacatctcacacttgcggactgaagctgcgaggagcggagaacccggccagggtcacggacgggagcgtccggactcgggttctctgggccccagcccccactccgcccccagcgaatccaaggtcccctgtagggaagggccgtccacactccccatcccttactggctgcatccactgaagcccagacctgctgcctgcaggacctcacccaggcaccaggtcgtgcctggcgcctccttgatgccaggccctggggagacctgtggccacagaacccatgttctccctggagatggacaggaggcccctctcctacgcagaagctgtcgttttttcttcttaaacaccgtttgcccctccctccacccaccgagccatctctgcccctctctacagcaaagcttccgccaagccggccctgctccctgtctacctctcctgccaccacccactcacacgttttaaatacaagccgtcggttctcaga

SEQ ID NO: 59139 - DNA, 340 bp, Homo sapiens
cgcccccgggaactcgctggaaacgcgagttctcggccttcgcccagaccctccgaatcgaaactcctgcggcgcgcgctgccagcccgagggccccgccgtccaggggtcccctgacatctcacacttgcggactgaagctgcgaggagcggagaacccggccagggtcacggacgggagcgtccggactcgggttctctgggccccagcccccactccgcccccagcgaatccaaggtcccctgtagggaagggccgtccacactcgtgagtgcaaccgctcacttcgcccaggtcaaggacgcggcattggcccgagtcgcccatgaccttcatttc

SEQ ID NO: 59140 - DNA, 2679 bp, Homo sapiens
agcgtggtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59141 - DNA, 1836 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaatacctagaagtggaattgctgggtcatatggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtg

SEQ ID NO: 59142 - DNA, 570 bp, Homo sapiens
agcgtggtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaagg

SEQ ID NO: 59143 - DNA, 909 bp, Homo sapiens
cctctgggaaagagacagttttactgagtcagatggtggaaagacagatgtctctatactttcttaacaagccactctgtcccataacatgcacttggaatctctcctaagttccagaggccccactgttccagtttcaagccttcattttggagtctgtttgggaacttttaagacttcaaagcaaagttagctaccagcaatttctgtaaaccaagagaagattgtcacaaagattcactactttccaactgaatctatgcagtagaaaaatcattagaaaatacaaaaattagccgggcgtggtggcacatgcctgtagtcccagctactcgggaggctgaggcaggagaatcacttgaacccaggaggcggaggttgcagtgagccaagatcccgccactgcactccagcccaggtgacagagcaggactctgtctcaaaaaaagaaaaaagaaagaaagaaaaatgattagaaattgagaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagatggagtcttgctctgttgcccaggctggagtgcagtggcatgatctcagccactgcaa

SEQ ID NO: 59144 - DNA, 326 bp, Homo sapiens
aggtttgtggcagatctcaccaatggcacctccttcctgtttttattcctatgttttacaaaactgtttataccacattaatgagcctgtgtgtttttaattgtttgctagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtg

SEQ ID NO: 59145 - DNA, 1614 bp, Homo sapiens
cctctgggaaagagacagttttactgagtcagatggtggaaagacagatgtctctatactttcttaacaagccactctgtcccataacatgcacttggaatctctcctaagttccagaggccccactgttccagtttcaagccttcattttggagtctgtttgggaacttttaagacttcaaagcaaagttagctaccagcaatttctgtaaaccaagagaagattgtcacaaagattcactactttccaactgaatctatgcagtagaaaaatcattagaaaatacaaaaattagccgggcgtggtggcacatgcctgtagtcccagctactcgggaggctgaggcaggagaatcacttgaacccaggaggcggaggttgcagtgagccaagatcccgccactgcactccagcccaggtgacagagcaggactctgtctcaaaaaaagaaaaaagaaagaaagaaaaatgattagaaattgagaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctctattagattgaagtacacaacctaatatgatatattattttgtagtatctcagactttgtaaataaataccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacactttaaaataatgttagtctcattacta

SEQ ID NO: 59146 - DNA, 877 bp, Homo sapiens
tgtggtggcgcatgcctgtaatcccagctactcgggaggctgaggcaggagaatctcttgaacccaggaggcaaaagttgcaatgagctgagatcgtgccatttgcactccagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctctattagattgaagtacacaacctaatatgatatattattttgtagtatctcagactttgtaaataaataccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacactttaaaataatgttagtctcattacta

SEQ ID NO: 59147 - DNA, 3069 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59148 - DNA, 2663 bp, Homo sapiens
cctggtggcgaattcggcacgaggcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59149 - DNA, 2657 bp, Homo sapiens
gaagggagcaccctggaccctttctgctattaggatgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59150 - DNA, 3018 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaagcaacatttcatttgttgcatttccagtttccaataccaactcacctacaaagattttaccaaaaaccttaggaccaataaatgtgaatgttggaccccaaatgtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59151 - DNA, 1908 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaagcaacatttcatttgttgcatttccagtttccaataccaactcacctacaaagattttaccaaaaaccttaggaccaataaatgtgaatgttggaccccaaatggatgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtg

SEQ ID NO: 59152 - DNA, 1130 bp, Homo sapiens
agcgtggtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacactttaaaataatgttagtctcattacta

SEQ ID NO: 59153 - DNA, 1062 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaatacctagaagtggaattgctgggtcatatggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaagg

SEQ ID NO: 59154 - DNA, 328 bp, Homo sapiens
gtatgttaactgatgctttcatgtgttgtccctgattaaatgttgaatccaaacttgttaaaacctttcttatagaaaattgcaaaattttagaacatctgtgcttgtgtcgacaaactgaaacctttaacactttaggaccattttttcaaaaattagattaaatagtttgtttcataacattatgaacttacatctatacaccacacattatatactattacatctaaattggctcactcagcactgaatttggctcttcagagagatcttgtaattcccagtacctagcttagagcctagttagagtaagctagtaaaagctcaa

SEQ ID NO: 59155 - DNA, 295 bp, Homo sapiens
attgggaaagtgttttatttgagatgtcattcccctgacagagcagaatgactcatggctctctaaatggtagcaatttctagcactatagctggatttaggcccccattctgttacttaaactatagaatacaaaactattcagacctctccagcaccaccaaaaaccctttactttgtttcctgatgcaggtttgagtatcttttcaattttgacaacacctttgagatccatgatgacatagaagtactaaagcggatgggaatgtcgtttggcctggagtcaggcaaatgc

SEQ ID NO: 59156 - DNA, 3140 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaagcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59157 - DNA, 2684 bp, Homo sapiens
ctgctttggagccagcagatactctgatatgtataattcaaattatgcaggtttcacgagcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59158 - DNA, 2672 bp, Homo sapiens
ctgtaatcccagcactttggggggccaaggtgggcggatcacctgaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59159 - DNA, 3243 bp, Homo sapiens
agctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaagcaacatttcatttgttgcatttccagtttccaataccaactcacctacaaagattttaccaaaaaccttaggaccaataaatgtgaatgttggaccccaaatggatgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59160 - DNA, 2575 bp, Homo sapiens
agcgtggtagaatgttgttggtactgcagtgagaggcatgcttccttagaccagattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 59161 - DNA, 1211 bp, Homo sapiens
agcgtggtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaaggtacgtatttttttcagggttagaaaggcaaaccccagagccctgactgtctgtgtaggggtgagccggggtcatgttactg

SEQ ID NO: 59162 - DNA, 1951 bp, Homo sapiens
gtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacaaaaaaaaaggggggtcaaagtcccgggccatacgcgtcccgttgtaaggccaagaggttaaaagggggaacggagagcgtcttagacttgtggggaccgaacggaattgggtgcgggaggagacagagacgtgcag

SEQ ID NO: 59163 - DNA, 1502 bp, Homo sapiens
gttaggctagtacgaggcttgggtgttggttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59164 - DNA, 1587 bp, Homo sapiens
cgctgttgagatgattcctttccgttcgcggaagagatggggaaactgagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59165 - DNA, 1762 bp, Homo sapiens
gtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagcctcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59166 - DNA, 1425 bp, Homo sapiens
gtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattgaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59167 - DNA, 784 bp, Homo sapiens
aactctagaggaacccctgtatcctggagcacaacatcagtatcaggcaataaaagaaaatttgcacagagtaaacaggctgacaaacttctacctgatttgagttagtctagttattctctttctatcacttacctctgattctctttaggtcaataatcttaaaaaagagaataattttaataattgaacctatcatttatttaatgaagttatagattacctaatgccacgctgagtaacagcagaactgaaacttttaaccttctcttcttacaattagctttcttttaaaaaataaagtaaatttgtgaactactccccgggatcagctgtatcccggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59168 - DNA, 527 bp, Homo sapiens
tcgagctcggtaacaccttgtgcaaaagtccccccatgtctcgtcactccagtgggaggctccctcggaaggggcccgccccccggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59169 - DNA, 490 bp, Homo sapiens
gcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggc

SEQ ID NO: 59170 - DNA, 822 bp, Homo sapiens
gcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatcc

SEQ ID NO: 59171 - DNA, 1815 bp, Homo sapiens
gtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59172 - DNA, 2013 bp, Homo sapiens
catgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatgggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 59173 - DNA, 2229 bp, Homo sapiens
gcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatgaaaaaaaa

SEQ ID NO: 59174 - DNA, 2772 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 59175 - DNA, 1070 bp, Homo sapiens
gggaaggggacgggggctgttggacatgcgcgcagagtccggcggccacggacgcggtaatattgtccctcggcatccgccgtggtgagacccggcgcgttgctgtgaagacggacgggtctggaagaagtggggtgcggtgagctgagcagaccttttccgcttcgacgtggggactgcagtgaccccggcctgctggcggggcgggtaacgggttgagccagggtggggctgctcagcggcatggagctgaggtctgaagacccagcacaggcgattcctttctgcgacgagacaattgctatggaaaccaaagtgctgggtcagcggggattgaggctccaggatcaagactggtgtctttccggaagacccttggctaaggcttcccggagcggctgcttcctgaatgaatccgccatctcctgcggggtcttgacaccgagcaggcgaagaagcctattccaatgccagctcccccgggaaacctacctggcccacccctataagtggtgcctcgctctcgttaactcttagactttgttccacgtttataacctaatatttcggtaacgccccgcggtttttgtttacttttcccacacataatggaccagaaagacttgcttccggactttgctttatgactctgaacaagtcatttttcccactgggtctcacttccctcttgtgtaaaatggaaatattaactctagatgccggtctggttaggtttgaagatcgaaccagatgagggaagccaaagacttcataggctgtaaagtggtgaaactgaactgctaacgagttgctatttttttctcccctccctctccctcaagctaaaagttcttcagatttcttgtgatttcttcaggcggtcttgggactccctagcctccgacctggaatagatctctcttcacacttcacttccacagagcccttcattttaacttccctatccaaagcaagaaaaatagttatcatttttagagggcttactctgtgccaagccctgataaaactctttacctggattatctcattaaatttcacaacatcctttt

SEQ ID NO: 59176 - DNA, 3250 bp, Homo sapiens
  misc_feature (2041)..(2041): n is a, c, g, or t
  misc_feature (2050)..(2050): n is a, c, g, or t
  misc_feature (2054)..(2054): n is a, c, g, or t
  misc_feature (2061)..(2062): n is a, c, g, or t
  misc_feature (2073)..(2073): n is a, c, g, or t
  misc_feature (2077)..(2077): n is a, c, g, or t
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaaggggctttcctttcccccccccaaantttttcccnaacnaaccccnncacaatttggnttcntttaaccccaaggcccccccttcccccctttgggccccatcccaggcccagcactggtgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 59177 - DNA, 797 bp, Homo sapiens
gggaaggggacgggggctgttggacatgcgcgcagagtccggcggccacggacgcggtaatattgtccctcggcatccgccgtggtgagacccggcgcgttgctgtgaagacggacgggtctggaagaagtggggtgcggtgagctgagcagaccttttccgcttcgacgtggggactgcagtgaccccggcctgctggcggggcgggtaacgggttgagccagggtggggctgctcagcggcatggagctgaggtctgaagacccagcacaggcgattcctttctgcgacgagacaattgctatggaaaccaaagtgctgggtcagcggggattgaggctccaggatcaagactggtgtctttccggaagacccttggctaaggcttcccggagcggctgcttcctgaatgaatccgccatctcctgcggggtcttgacaccgagcaggcgaagaagcctattccaatgccagctcccccgggaaacctacctggcccacccctataagtggtgcctcgctctcgttaactcttagactttgttccacgtttataacctaatatttcgctaaaagttcttcagatttcttgtgatttcttcaggcggtcttgggactccctagcctccgacctggaatagatctctcttcacacttcacttccacagagcccttcattttaacttccctatccaaagcaagaaaaatagttatcatttttagagggcttactctgtgccaagccctgataaaactctttacctggattatctcattaaatttcacaacatcctttt

SEQ ID NO: 59178 - DNA, 3265 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 59179 - DNA, 3192 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 59180 - DNA, 2150 bp, Homo sapiens
gggaaggggacgggggctgttggacatgcgcgcagagtccggcggccacggacgcggtaatattgtccctcggcatccgccgtggtgagacccggcgcgttgctgtgaagacggacgggtctggaagaagtggggtgcggtcatggagaaatgttgtagagggaaggaacaaagtctactgtgcatccagcaaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 59181 - DNA, 627 bp, Homo sapiens
cagacctgaaggtcaatgattgtttaatctttctttgacagcattatgaaggtataatgggcatacaagaaactgcacgtctttaaagtgtacagttggagggtttttggcatgtgtggacacccatgaaacctcccccataatcaagacagtgaattgatccgccactcccaaaagtggccttgcgcctccagcaacccctctttcctgctcctcactgtcccccatccccaccgccactgcttggcttgctgtcactatagattaattcccattttctagaattccatagaaatggactcatacagtgtatgtctggcctctttcactcagcacaattcttttttcatcaggtgtttttgtgcatatcagtactccatttttttttattgttggtaggatcccattgtatgggtggaccacaatacctgttgaatacctgttgatggacatttgggttgttaccaggttttggccatgacaaataaagctgctgtgaacatttgtgtaccaatttctgcgtggacatatgttttcatttctcttggatatacggctaggagtggaattgttgggtcatgtggtaactctgtgttcaactgtgcgaggaactaccaagcttttcca

SEQ ID NO: 59182 - DNA, 573 bp, Homo sapiens
cagacctgaaggtcaatgattgtttaatctttctttgacagcattatgaaggtataatgggcatacaagaaactgcacgtctttaaagtgtacagttggagggtttttggcatgtgtggacacccatgaaacctcccccataatcaagacagtgaattgatccgccacccccatccccaccgccactgcttggcttgctgtcactatagattaattcccattttctagaattccatagaaatggactcatacagtgtatgtctggcctctttcactcagcacaattcttttttcatcaggtgtttttgtgcatatcagtactccatttttttttattgttggtaggatcccattgtatgggtggaccacaatacctgttgaatacctgttgatggacatttgggttgttaccaggttttggccatgacaaataaagctgctgtgaacatttgtgtaccaatttctgcgtggacatatgttttcatttctcttggatatacggctaggagtggaattgttgggtcatgtggtaactctgtgttcaactgtgcgaggaactaccaagcttttcca

SEQ ID NO: 59183 - DNA, 369 bp, Homo sapiens
atatatacactaatataaatatatatttatatacatttccttacatcaaccacattttaaaaaaccccactttgggaggcaatgagatgatttaaaagtagctactacttgtctcaaagggtttgctacctgaacaggaagaagtgctggggattaaataggtagtaactgtgcattgttgaacactgtgcaagtaattagggtattcagaaggcatcaaaattttttatactgaggcaagtagcaaaataggagcatccaatttacattttacaaaggaatagaagaagttggccatgtagaaatattaaagaagacagtaccaagcagataaaacagaaacgaccataagggtggaagtttaagggg

SEQ ID NO: 59184 - DNA, 1035 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggaggaggaatgatgggatttcatattttatttcacaccagttcctccttgtttcatctctttgctaagctggctgcttctaccatctaataaataattggccaagttcttttttt

SEQ ID NO: 59185 - DNA, 857 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtatatacgctgcagtgggactgctggatctatggtagctcaatttttagtttttgaggaacaacctccaaactgttctccatagtggctgtactaatttacattcccaccaacagtgtacaaagattcccttttctccgggtcaagttcttaatggctgcaaattaatgagcaatgtatttggtgcttcagataaat

SEQ ID NO: 59186 - DNA, 955 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagcca

SEQ ID NO: 59187 - DNA, 841 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggcgcagctgcagaacctaccagcagttccgattcatcacctccaagctccttaagatgcacagtcagggcttcttgtcctgttaaataccaccccaaccccaggcctccactggagattaaaaaccttcattcaaagcca

SEQ ID NO: 59188 - DNA, 879 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctggtaaaagagagacattgctggacaagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcggggtatatacgctgcagtgggactgctggatctatggtagctcaatttttagtttttgaggaacaacctccaaactgttctccatagtggctgtactaatttacattcccaccaacagtgtacaaagattcaacaaaaaaaaaaaatccccaggt

SEQ ID NO: 59189 - DNA, 900 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcggggtatatacgctgcagtgggactgctggatctatggtagctcaatttttagtttttgaggaacaacctccaaactgttctccatagtggctgtactaatttacattcccaccaacagtgtacaaagattcccttttctccgggtcaagttcttaatggctgcaaattaatgagcaatgtatttggtgcttcagataaat

SEQ ID NO: 59190 - DNA, 223 bp, Homo sapiens
ataaaggattactgattgcatttacttacctttaaagttcttcagttgttgacactactgccacatgcttacttgctttattgagaggaaattttaatatctaaagatttgttaatgtaactataacgtagaattaagcaatggatactcttctgcctagcaggagtgacagcatctcatggtggagaaagcactggatgtatgactctggcaatatcatttt

SEQ ID NO: 59191 - DNA, 578 bp, Homo sapiens
gagtccatgggtattgggtgtgtgtcccgtcaacctcacatcatgcaaaaacgtaggactgagttgtgaagagtttattcaagtgaaaagctgggaatggccattcaggaaaagacacactccagagaaatgggcacagggctccaaagacaagagttctttcttagattttcaatgaatcattttcaccagtcctaacagtctgcgggtcacctttccttctgttctaactgctctccttgtacccttgggagggtttgtgatgctgtcctgtttggaaaagccatgctgctctctttacacttcacagtagcttggtttggatcatttctgtgctgtgctcagatgctccttccttcatataaggttgaggaaaaggagacacatctgacccatccatgtgtgtttgtgaaacaggcagcagcaaataattattcagttttaggaattaggctcacactggagggagaggtcagagcccttcgggggaatatttatgaacaagtaacagatgattaaattctccaaagcaaacaacttttctacttgagaataaagtgtttctagttaaattatgc

SEQ ID NO: 59192 - DNA, 362 bp, Homo sapiens
  misc_feature (357)..(357): n is a, c, g, or t
ccctaaggctggctttattatcaagtgatttgcccgcctgtgtgggtagtggtttccctaatgagtaggatgcagggttgagactggggagctcctgcagcatgaggctcttaactgatgggacgccagcacaagacattcagtacattgtggctgtcaggagctggatgggaaaagtagttacttttcccttctttgcccattcccaatatcagcagtcctaaccttattttattttattgtattttattttaatttttttaagactccatcttgaaaaaaagaaaaaattcccaaaagaaagctttaattttaaggtaaatagttataaataattggtttgctaccatgattttngtaga

SEQ ID NO: 59193 - DNA, 730 bp, Homo sapiens
gcggggagcgggctccgctggggagccgaaagcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggagcggggtgacagcaacagcgacgactatgacctcgagtctaacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctccagagattgaatcaagccccc

SEQ ID NO: 59194 - DNA, 667 bp, Homo sapiens
gcggggagcgggctccgctggggagccgaaagcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctccagagattgaatcaagccccc

SEQ ID NO: 59195 - DNA, 300 bp, Homo sapiens
gaagggtattgtaggggtagaggatgacacgatggcagggaacgctgagggttgtaggggatgtaggaagaatagggcgtggcggcaagagcgaaggatatgaactcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctccagagattgaatcaagccccc

SEQ ID NO: 59196 - DNA, 170 bp, Homo sapiens
ctctcccccacaggttctcagcagttactaagatgtcccctgatttcattgacctctgtgtgtcttcagtccttgacctttaaggctccctggtgccagaatgtctgcagctgtaggatcaaagacccttgggggaaaaatccattctcaaaagagaggaagatggggtg

SEQ ID NO: 59197 - DNA, 316 bp, Homo sapiens
  misc_feature (21)..(21): n is a, c, g, or t
caagtcacagggccccccttngtggcgcggatgttaagattgatatcgaattccgcaagacatgatttggatagaaatatagttgttgcttagatgatctctatatcattccaaatgtgactggcctgattatttttcctgataaactgtctaaaatagctcattattttcatgtcatatagacacgaccttaaggataaaaaaattgaattaaatgggcaatatttcagcaatagtcattttccattccagatttaaaatcagaatcgaagaacataatggatttaaacccagttcagtgcacatgtatcaaaca

SEQ ID NO: 59198 - DNA, 2117 bp, Homo sapiens
agcggacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaagtattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59199 - DNA, 2095 bp, Homo sapiens
agcggacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacagatggtttttgtcaaagattcaggatgacttcagaggtggaaaaattaacctagaaaaaactcagaggttacttgaaaaattagatattcggtgcagttatattcatgtgaaacagatttttaagaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaagtattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59200 - DNA, 1189 bp, Homo sapiens
atctccagttgtggcagccgaaaatgtctccagacattgccaaatccctcctgtgaggcaaagtcgtcccagtggaaaaccagtagcctgtagacatgggtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaagtattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59201 - DNA, 1390 bp, Homo sapiens
agcggacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagagcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59202 - DNA, 513 bp, Homo sapiens
cagggtgatttacactgtgctcccaattaccttgtctcaatatgcttacttttctaacagcatctgagatgtgcctaggaaacaggtcttcctgaagcagaagggtggtggctaattttggatcatgcagcgctttgcggaaggagaagtatgagctgtgtattcagttttgggcagttaggaagtcagaatagaaaatgcaaatatttaatttttgtggaagattaatataccagatgggaatataactctatagtcatggtttttaatgtaggcttagtaaagagctcttgtttctcagcaaggctattggagacaccactgattaattggttattggtctaattagatataattccttttgcaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaat

SEQ ID NO: 59203 - DNA, 1420 bp, Homo sapiens
atctccagttgtggcagccgaaaatgtctccagacattgccaaatccctcctgtgaggcaaagtcgtcccagtggaaaaccagtagcctgtagacatgggtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaagtattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59204 - DNA, 1883 bp, Homo sapiens
agcggacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaagtattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgc

SEQ ID NO: 59205 - DNA, 794 bp, Homo sapiens
acgagagcgagcgagggagccagcgagagagggagggagagaaggaaagaagaggggaggggtgggggcgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtctttttttttttttcaaacaatgcttcttttggacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggtaggaattatccttgcacaccagtgatgactggatgccttttaaag

SEQ ID NO: 59206 - DNA, 3431 bp, Homo sapiens
ggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaataacgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59207 - DNA, 3423 bp, Homo sapiens
ggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaataacgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59208 - DNA, 3364 bp, Homo sapiens
ggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaataacgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59209 - DNA, 3361 bp, Homo sapiens
tccggagctctctcgcaggagttcttcttttggactggtccaggaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59210 - DNA, 3899 bp, Homo sapiens
ggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaataacgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcaaaaaaaaaaaaaaaaaaaaaaaaaaaaaaaaggggggcgcccccccccaaaagtttcccccgcggggggccccaaagctttccgcccgttccccgcgtttttttgtggttccaagggggccccctatgagggggaggcgcgttttaaaagcctgaggcccgtgggccgccgccgttttacacaaccgctgggtgcagcggggggaaaacacgcggcgctagtcctggggaatctctgcgggggaggggacccctacacctctgcgtggggggtgggaccctatacttggcgcaccaaacctcccatactcagagaatttaaaaggcctcataaggggtaaatttctaaaactttctcagccggtgtttcttagcgggggcttcaacccatgggctgtaatagtgccttgggcggctagaaaagttgtggcctaacgcggagatattgattttcggaaactttttatcc

SEQ ID NO: 59211 - DNA, 2057 bp, Homo sapiens
cccattgtgtattgtaaagagcacacaatggctttgttttgctttttcagccacaccccttacgtgatacccaaaggcactagttcacataaggggtgtgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59212 - DNA, 1286 bp, Homo sapiens
  misc_feature (52)..(52): n is a, c, g, or t
  misc_feature (197)..(197): n is a, c, g, or t
agataggactttgctagtagcgataacgaatagtgtgccgacgtggtcctgntggagtaatagtagatatatggtgttattacagactagtattgcatattgagaagaattcgaggatctatatgatgatgatgactctggaattctctagcgagattgagagagaaccgcactggttgaggcatgcagaagctgtntgtgagagtagtgtactagagtggtagtacatgacgagtctataattgtgatctatgcaatgtggagtctcgggtggaggtcgatattaaataagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59213 - DNA, 3781 bp, Homo sapiens
acgagagcgagcgagggagccagcgagagagggagggagagaaggaaagaagaggggaggggtgggggcgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtctttttttttttttcaaacaatgcttcttttggacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59214 - DNA, 3372 bp, Homo sapiens
tcctcagtcgactcctgcagaggtcacattttgtgtgcgggtttgtccccagcgtttgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 59215 - DNA, 3708 bp, Homo sapiens
ggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaataacgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgcttttttttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacactatttgattgcacttaattggcaaaatttaagatgatctctagaaagcatatgttaagtccatgaaaagaaaaaaaaggtgtgtaaggacatttactttctaaagctaagtcataacaagcatagacaaagcaccccaaatgtttctctgaatgtaatgtttaggatctctgcgctaggtcgtttaccgctatttatttttatggggaaaataaaactctcaaaaatgaag

SEQ ID NO: 59216 - DNA, 184 bp, Homo sapiens
atatgtagctggacatactcttctattttcaattacattttgttttactttcacccacttgctatgtagtttttcatctcatgcatttttttgatactttatgtcagtagtggctgaattgtatttgaaaaatatgtatcatatataattacatacacacaattaaagctaagtttatttcaaa

SEQ ID NO: 59217 - DNA, 659 bp, Homo sapiens
cgatctagaggatctcctccataatgtgtgcccacttactgttcccccaaaccttcttgctcttataagctttgtcaaagctattactccaggttgtagtgcttttttttctactttactttgatctaagtcctgtctttccttcaaattttggctacttattgcatgaagctttttccaatatttccattcttggtggtaattttagtctaagaattcctgaagtactacctaattgaaacacacatttgatacttggatcatgttatcttgtattataacttattactccattaatatatcctcggccgggtgcagtggctcctgcctataatcccagcatgttgggaggccgaggtgggagggtcatttgaggccaggagttggagatcagccttggcaacatagtgagaccctgtctctacaaaaaaatttaaaaaattaaaaaaattaatatgtcctatttctttagcaaaatcattggctccttgaggggagagagcttgtcttatatgcccctttgtaattccattgcctagcacagcagatgttgtcactaataggtttgattctgtgatttggatccaatgtcattgtgacaggatactttttcccccataataggttatttttatatgactttatgcccacaaaaccca

SEQ ID NO: 59218 - DNA, 957 bp, Homo sapiens
aaaaacacctcacttgctagagttctaaatcaagtttctaattctaaaaacttggctgtgtagttaagtacaaggcctgaataactattgtagaggttataggacagagagatctccatgtttttataggtgggatattttttgttgttgacagaagtaacttcgcctgatctctgttccattattttaattttttttttttactttatacactaaaaatttggattaaaaaatgaaaaatgtaagaaatcaaatgttactcaaaaagtattgttttgctcccaactctgcaattctacatgaagccatttgccaaagccagatatggtttacttactgttcccccaaaccttcttgctcttataagctttgtcaaagctattactccaggttgtagtgcttttttttctactttactttgatctaagtcctgtctttccttcaaattttggctacttattgcatgaagctttttccaatatttccattcttggtggtaattttagtctaagaattcctgaagtactacctaattgaaacacacatttgatacttggatcatgttatcttgtattataacttattactccattaatatatcctcggccgggtgcagtggctcctgcctataatcccagcatgttgggaggccgaggtgggagggtcatttgaggccaggagttggagatcagccttggcaacatagtgagaccctgtctctacaaaaaaatttaaaaaattaaaaaaattaatatgtcctatttctttagcaaaatcattggctccttgaggggagagagcttgtcttatatgcccctttgtaattccattgcctagcacagcagatgttgtcactaataggtttgattctgtgatttggatccaatgtcattgtgacaggatactttttcccccataataggttatttttatatgactttatgcccacaaaaccca

SEQ ID NO: 59219 - DNA, 888 bp, Homo sapiens
aaaaacacctcacttgctagagttctaaatcaagtttctaattctaaaaacttggctgtgtagttaagtacaaggcctgaataactattgtagaggttataggacagagagatctccatgtttttataggtgggatattttttgttgttgacagaagtaacttcgcctgatctctgttccattattttaattttttttttttactttatacactaaaaatttggattaaaaaatgaaaaatgtaagaaatcaaatgttactcaaaaagtattgttttgctcccaactctgcaattctacatgaagccatttgccaaagccagatatggtttacttactgttcccccaaaccttcttgctcttataagctttgtcaaagctattactccaggttgtagtgcttttttttctactttactttgatctaagtcctgtctttccttcaaattttggctacttattgcatgaagctttttccaatatttccattcttggtggtaattttagtctaagaattcctgaagtactacctaattgaaacacacatttgatacttggatcatgttatcttgtattataacttattactccattaatatatcctcggccgggtgcagtggctcctgcctataatcccagcatgttgggaggccgaggtgggagggtcatttgaggccaggagttggagatcagccttggcaacatagtgagaccctgtctctactagaaatataaagattggccggatgtggtggtgggtgcctgtaatcccagccacccgggaggctgaggttggagaattgtttggacccaggagacggaggttgctgtgagcccacatggtgccaatgcactccagcctgggcgacagagtgagacaccgtctcaa

SEQ ID NO: 59220 - DNA, 697 bp, Homo sapiens
gcggaagaaaaaggatgagacatgtggcttgtgggcagaaagggaggcaggagaacattcccagtctgcctttcactgagtttttacctgttcactagaacaacaaaagggaacccaatcgggaaactctgctgtcaactaagcaaactctaaatttaacatttgggggacccccttggagagtagttgagagctatgtgctccccttttcagaaaaatgctctcaaatactcagtgcataagcccacagccttagcaggttcccagaccttaggtcagcaatcctgttctaaggcatacatcacgagcagcattttgattttcatctggggaacttatagttcataaagacctactgatccattaaaatttccacttgattttgccattagtaatctcttaaacaagtccaaggaagccagaggaagttatttcttgaatgcttttatactagtgctttcaagagttcgtgttgctgactccagtttttaaaattattattctcatcttctgcaatgcctcgaggcatgtttttagctgaatagcaataattatgggattgtgcaatactggaagaagcagtaaaaataaaatgtaatactaaaaaaaaaaaaagtctttacttcatctaggaaattcagtttaaagaatttttacctccggacataacagtgactatgctggaactctgtctttg

SEQ ID NO: 59221 - DNA, 898 bp, Homo sapiens
  misc_feature (870)..(870): n is a, c, g, or t
aaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcagtgaaccgagattcgccactgcgctccagcctgggtgagatagancaagactgtgtctcaaaaaacaaaacaa

SEQ ID NO: 59222 - DNA, 984 bp, Homo sapiens
  misc_feature (876)..(876): n is a, c, g, or t
  misc_feature (891)..(891): n is a, c, g, or t
  misc_feature (956)..(956): n is a, c, g, or t
aaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatggcatgatctcagctcactgcagcctctgcctccnggagaatcgcttgancccgggagacggaggttgcagtgaaccgagattcgccactgcgctccagcctgggtgagatagancaagactgtgtctcaaaaaacaaaacaa

SEQ ID NO: 59223 - DNA, 1055 bp, Homo sapiens
  misc_feature (947)..(947): n is a, c, g, or t
  misc_feature (962)..(962): n is a, c, g, or t
  misc_feature (1027)..(1027): n is a, c, g, or t
aaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatggcatgatctcagctcactgcagcctctgcctcctactaaaaatacaaaattagccaggtgtgctggcgcatgcctgtaatccccgctacccaggaggctgaggcnggagaatcgcttgancccgggagacggaggttgcagtgaaccgagattcgccactgcgctccagcctgggtgagatagancaagactgtgtctcaaaaaacaaaacaa

SEQ ID NO: 59224 - DNA, 1942 bp, Homo sapiens
aaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatggcatgatctcagctcactgcagcctctgcctcccgggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggatggtctgggtgggcccagtccattgggtgagtccttcaaaggtggagacctttccctgctggccagagagaggctgtcttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataatagtagaaataaagtgcacaataaatgcaatgcacttgaatcgtcctgaaaccatccctccccgaccccaatccatggaaaaattgtgttccgcgaaaccggtctctggtgccaaaaaggttggggaccgcttctggaaaagctggaaaaggcaagaaaacgcattctctccctcagcctctggaaggaaccagcactgtgggactaatttacatactgtagggtaataaatttgtgttgcttcgaaccactaaatttatggtaatttgtttgcggcagcaatggaaaact

SEQ ID NO: 59225 - DNA, 2080 bp, Homo sapiens
aaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatggcatgatctcagctcactgcagcctctgcctcccgggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggatggtctgggtgggcccagtccattgggtgagtccttcaaaggtggagacctttccctgctggccagagagaggctgtcttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataatagtagaaataaagtgcacaataaatgcaatgcacttgaatcgtcctgaaaccatccctccccgaccccaatccatggaaaaattgtgttccgcgaaaccggtctctggtgccaaaaaggttggggaccgcttctggaaaagctggaaaaggcaagaaaacgcattctctccctcagcctctggaaggaaccagcactgtgggactaatttacatactgtagggtaataaatttgtcccacagtgcgggctcccactgagtctctgtgatggtgagttgtcagaattcatttaattatatgttacaatgtcataactcataagaaataaagtgcacaataaatgcaatgcactttgaatcgtcctgaaaccatccctcccgacccaatccatggaaattgtgtccgcgaaacggtcctggtgccaaaag

SEQ ID NO: 59226 - DNA, 358 bp, Homo sapiens
cttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgcacatggtaaaaag

SEQ ID NO: 59227 - DNA, 805 bp, Homo sapiens
  misc_feature (781)..(781): n is a, c, g, or t
gtatttgaagttatgtggcatttctgctgaggtaattttttaaagttaactatgacttgattcagctgaacatttttttgcagacaaaatctagtgcactaccagataggcatatagcaatagaacaattaaattttataaatattttaagaatagactgcttctttctgaatgtttttgagaaagacagggtgatagtttatctaaacattaagatcggtaaatagaattttaaataaaattgctgctttggtaaatttacctcttaattgtttgcatttggtttataaacactttccccttctcattgcaagttttaaaaaaaaatgaagttcagagggatttttagtaattatttggaccaataaactcaggtattctgccatgaacatcattactacagccaaataagctttcaggtactcaaccattgaactatatttttgtgcataggaaaactatttcgaaaacagttttgaaaatgaaaatgctaatgttgagttcagcaccactgtgccatcatcaccaaccttatgattcacagaaggagcaaagacaagggtgtctgtttatgaaatgcattcctctggtctagtgatcagggcatacgccacatggagagggccacgctaaataaaaacaaaagctattaacagcagatacagtaaagagattacaaataaattggtgtgtgttgcctcatgagaatcactcttttgtgagagaaaggttccctcttttgcattttttaggctgtgaacataggtacctacatcaaggnttaccagtcacctcttcaaaacca

SEQ ID NO: 59228 - DNA, 565 bp, Homo sapiens
tgaggtgatgtggcagttaaaacacttagaacagtcagtgcctagcatgaaacaagtgatcccagcatagaagctctgctttcatagcctcatctggaaaacaagatccacctaagtgtgcaaaaacctcacatcctttggcaatccatttgtggcacaaataaaactggatcagattgcagcatcacatttgagaaatgtaattcctgataagtttcttgagcacgacttagcccccacgaggctgggtagtcagagaagttgccacaaatgctgttgactgtgttgaggagagcaggtggaatgggctctggctggactgggcagtatgtaccctctgcacagaggtaactggccaaaggtgcccatttttcagcagaagccccaaaccctgatttttaatgtgaaatatcctgatttccaactttagcaactcaatttcttctaaacactgtgtgggccagaccagacgcaggtgcatgcagccagtttgtgccacctctcccagtggccctctctgactgccacccctggagcttttagtgcctgcggcctcacacacttc

SEQ ID NO: 59229 - DNA, 318 bp, Homo sapiens
ctgagttttgatcaaaaatagtgtacctgtgtagtgtggttaaatcatgttgacctcactctctttcatctagcctcttaaaatatcaatactaagacttataaaatgagcatatgaaaaccagtaactttccttcctacagattgaaaatactcaatcagaaagtatattcaaagaaaatatttaatccacagtagcgacataaaaattggttttaaaaaaaatctagtaataaaccttagagaaatttgaagaaactatataaagaaacaagaaactcaattgagtgtcataaaacgaaacttgaatgaatggttt

SEQ ID NO: 59230 - DNA, 300 bp, Homo sapiens
ggctgatttttaaatttttgttgttgttgttgtagagacaaggtctcactgcgtggcccaggctggtctcaaactccttagctcaaacaatcctcccacctcagcttcccaaagtgctggtatttattacaggcatgagtcactttcctagccttgtatgaaattttattttatttatttatttaaaaattgagataggatctcgttatgttgcccaggttggtattgaactcctgggcttaagcaatccttctgccatgccctcccaaagtgctgggattacaggcatgaaccatcaca

SEQ ID NO: 59231 - DNA, 691 bp, Homo sapiens
acgcgtgtgcttgtgtgcctgtgtgcgagcgtgtgcattatgtatgcgtgtgtgtgcactcctgtgcatgtggctatatgggcgtgcacacgcgtggttaggtacatgtatgtgtgtgtgcttctgtttatgcatgtgggcgggtgtgcttgcatatgtgtccgaggacatgggctgcaactcggaaacctgagcgtgggccctggccccttgagggatcccggcctccctgcaggatgtggccagcccaggtccccactcacgccctgccgtcgccttgttgcagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttag

SEQ ID NO: 59232 - DNA, 798 bp, Homo sapiens
tccccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttag

SEQ ID NO: 59233 - DNA, 436 bp, Homo sapiens
ctaagagtgagtagaaaagagtcaaaccatttataatttgatagaagccgcatttactgtaatagcactaaacttaaggtgttagaaaattaagcctttttttgctcaaaacctcttttgtgtttcagcttaaacagatttcttggcattcttccagttcattttcaacatttccgaggcgttactttactaagaagcaggaattgaactaaacttccaatttctaaaacaaaggagaaaacaggcatgtgatatacagtttaatgcagtaagcactggttacatagtatgtttgattacaattagaatatcattaagttttgtgactaggtaatcattacatagtaactattaattagacttaattattttatgtataaatttaatttaacagttacatactaacaatgcatgctaagaaatattagaaattttc

SEQ ID NO: 59234 - DNA, 1983 bp, Homo sapiens
tgtcatcgtgggcttgaggacctggagagagtagatcctgaagaactttttcagtctgctgaagagcttggaagactggagacagaaggcagagtctcaggctctgaaggtataaggagtgtgagttcctgtgagaaacactcatttgattgtgaaaagacttgaattctatgctaagcagggttccaagtagctaaatgaatgatctcagcaagtctctcttgctgctgctgctactcgtttacatttattgattacttacgatgattcaggtactgttgtaagtgctttacatgctgttatacgagactcttgggagaaatcactttaatgaagcttgagacacatggcattgccatgcaatgatttttcccccctcttcacgggatcagagggaactaatagaatgtgacaatgattctttagcagggactgctgaggcttctggttcctttttaagatctgcagtgaaagaagatgagaaacatggatatgcccttcttttggtccccctcttcctttatttgatctctacttccttctataaatatattagggctacattgtccctttgtatttcaaacaaggcaaaaagaggttgtaattacactttactgcaatcctcagtttctccagggaacaggaatgcaaaggctttgaaggcctctctatttgctgacatggtcagctgggtgccatgggccaagtccttctgttgccctcctctgtcaccaagtaagctaggtcctttctgaggctcaggtttgctgtgatgatgatcacttttaggcagaaggttagaggcctcatgagtgctatatggactttattaggctttagatttgatggggaataagggatgtgatttgtcttttgggaactcatctttgattcatcattgtctcttggtatcttggaatttccatgtcattacagtctacagaatgaaagagtaacctgtcccagaggagaggcaggtgaaagactccacagcatgctcattctcattctgtcttctcagtgacaccgaggtttactgagtgcccactatgtgccaagcactgtgctcagggctttctttgtatgcatgatctcagtgaatctcaccaagcctcatctggaaaacggggacaaattaacaacaggatggcaaattgaaaaacacgtaaccatgttctacagatggaaaggggtgcttggttattatgaaggccccctcgcaagcgtgtgggacatgggtgtgttctctgggttgtactgatcagatcaaggacctcccccacccttctcacactctgcccacttccgccctttgcttatcagacccttagccagtgactcattccagaaccagaaccttggtgaaatctcaaccgacaccagagatcggtgtcttcagtcctagactgatggagaaaatccagaatatatactagaagctccaaatgctctgggtttcagctcctctgtgctgtggacactgactttggctcagaactccgatttagtacaaaaggctcatttttatttcaggggcactcttcctaaagcaaacctaataaatgaaatatggaattcacagatacacacacacattaaaaaattaacctagtgtatctgtgaggagtaggcagaaattcactgtataaaagaatgcttcatttcatagagaatttgtgttaagattccattagatagtacatttctcaaagatttttgaggttgtatttgctttaccaaaacttggtttatgtaagtggaaaaagcatgttgcaaaataacttggtgtctatgattcagtttatgtaaaataataaatgtatgtaggaatacgtgtgttgaaagatgtacatcaatttgctaacaatggttatctctgacgtggtgggatttgagatgtgtttttctttttggttgtatttttctctattgtttgacttaacacagaacatgtttggttacaacaataaagttattgaagac

SEQ ID NO: 59235 - DNA, 2298 bp, Homo sapiens
tgtcatcgtgggcttgaggacctggagagagtagatcctgaagaactttttcagtctgctgaagagcttggaagactggagacagaaggcagagtctcaggctctgaaggtataaggagtgtgagttcctgtgagaaacactcatttgattgtgaaaagacttgaattctatgctaagcagggttccaagtagctaaatgaatgatctcagcaagtctctcttgctgctgctgctactcgtttacatttattgattacttacgatgattcaggtactgttgtaagtgctttacatgctgttatacgagactcttgggagaaatcactttaatgaagcttgagacacatggcattgccatgcaatgatttttcccccctcttcacgggatcagagggaactaatagaatgtgacaatgattctttagcagggactgctgaggcttctggttcctttttaagatctgcagtgaaagaagatgagaaacatggatatgcccttcttttggtccccctcttcctttatttgatctctacttccttctataaatatattagggctacattgtccctttgtatttcaaacaaggcaaaaagaggttgtaattacactttactgcaatcctcagtttctccagggaacaggaatgcaaaggctttgaaggcctctctatttgctgacatggtcagctgggtgccatgggccaagtccttctgttgccctcctctgtcaccaagtaagctaggtcctttctgaggctcaggtttgctgtgatgatgatcacttttaggcagaaggttagaggcctcatgagtgctatatggactttattaggctttagatttgatggggaataagggatgtgatttgtcttttgggaactcatctttgattcatcattgtctcttggtatcttggaatttccatgtcattacagtctacagaatgaaagagtaacctgtcccagaggagaggcaggtgaaagactccacagcatgctcattctcattctgtcttctcagtgacaccgaggtttactgagtgcccactatgtgccaagcactgtgctcagggctttctttgtatgcatgatctcagtgaatctcaccaagcctcatctggaaaacggggacaaattaacaacaggatggcaaattgaaaaacacgtaaccatgttctacagatggaaaggggtgcttggttattatgaaggccccctcgcaagcgtgtgggacatgggtgtgttctctgggttgtactgatcagatcaaggacctcccccacccttctcacactctgcccacttccgccctttgcttatcagacccttagccagtgactcattccagaaccagaaccttggtgaaatctcaaccgacaccagagatcggtgtcttcagtcctagactgatggagaaaatccagaatatatactagaagctccaaatgctctgggtttcagctcctctgtgctgtggacactgactttggctcagaactccgatttagtacaaaaggctcatttttatttcaggggcactcttcctaaagcaaacctaataaatgaaatatggaattcacagatacacacacacattaaaaaattaacctagtgtatctgtgaggagtaggcagaaattcactgtataaaagaatgcttcatttcatagagaatttgtgttaagattccattagatagtacatttctcaaagatttttgaggttgtatttgctttaccaaaacttggtttatgtaagtggaaaaagcatgttgcaaaataacttggtgtctatgattcagtttatgtaaaataataaatgtatgtaggaatacgtgtgttgaaagatgtacatcaatttgctaacaatggttatctctgacgtggtgggatttgagatgtgtttttctttttggttgtatttttctctattgtttgacttaacacagaacatgtttggttacaacaataaagttattgaagacaatataacacccaattgtgatgagtccagacagtactcatgctgtgcatttattagacagtatgccatagaggtgggtcatggaggagtggagagagagccctgatttgttgtcccatgaagaagataggcacagggtaatatgtagtgtgattctttttttttttgcacgaggagaagtgtgtgtgtatccgtgtaagtgtatggatatccagtgggtagtgggtgttaagattgcaagtgatttttttcccctctcccttaatcatgcttttctgcctaaataaaaaaagaactctctccaaaaatccatcca

SEQ ID NO: 59236 - DNA, 303 bp, Homo sapiens
attattccaggttatcaatactctggctgaccatcatcattgtgggactggctttcgtggaagtccttggttacatttcattattgcgtttccgagaagttataaagttttcattatcctctggacagtttacctttggatgtctctcctgaagactatcttgtggtctcgaaatggacatgatggatccacggatgtacagcagagagcctggaggtccaaccgctgtagacagaaaggaaataaaattggcctgaaagacgtcattactctatggagacatgtggaaacaaaagttagagc

SEQ ID NO: 59237 - DNA, 2503 bp, Homo sapiens
gacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttccgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagactctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaagtaagctggcaagatttaaaaaactgaacccaaataaatattcatcatttttttcttc

SEQ ID NO: 59238 - DNA, 2792 bp, Homo sapiens
gacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttccgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagagaaggaactggggaacctctagagtcacc

SEQ ID NO: 59239 - DNA, 197 bp, Homo sapiens
tctgtcacagtgtaacagatttacattctccatttgtctgtccgaagacaacatgagtgtttgcaggtcctacataaagtgatagatgtcacctaaaatattgtttgtctccttcagcagaagataaagatggcagaagaaaagggaaagcaagtataaaagatccacattttctaaatttcaacaaaaagttatca

SEQ ID NO: 59240 - DNA, 5558 bp, Homo sapiens
gacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttccgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagtacaaatctgaataggaaacaacttaagagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaacaaaaaaaa

SEQ ID NO: 59241 - DNA, 5530 bp, Homo sapiens
gacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttccgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaacaaaaaaaa

SEQ ID NO: 59242 - DNA, 257 bp, Homo sapiens
caaaatttttctcagcccattgtagaatgaaaagttaactcatcgagcttagtattgtgcctacaaggtcttcgatccggatgtctccatgagtgttaatccatttctggggtgggtactgctgagccaatatacattcctggcttcctggactcgtccactggaacgtgttgggtcctggtgctctccccagcagatggttgtaggtggtcagagatgagccacagaaaagccaacgtgcagcctggtgctggggg

SEQ ID NO: 59243 - DNA, 303 bp, Homo sapiens
ctaggcttcaaataaataaaattttcacacttgaaaattatgaacacttaaagcacacatattgactgtgatactgtgagccacatttccacttcaaggacttgcatcagtatttaaatgcaagagattggagtgctttctctgatacaggttgagttcatcatgggtgatttggggaaggtatagagaatccgattgtattaagcaagcttctatcccgcctgtcttatcaagttaactacatggtaaggtttcactggatttatccactgtgatgtgtctttcagaccataaaacacaata

SEQ ID NO: 59244 - DNA, 226 bp, Homo sapiens
  misc_feature (6)..(6): n is a, c, g, or t
  misc_feature (11)..(12): n is a, c, g, or t
  misc_feature (121)..(121): n is a, c, g, or t
gatcanggtgnngaattctttttctagaagtttttaggcagagggaacagcatgagcaatagcccagagggcacgtatggagtagagctggcagttcagtttggcaggagagtgggttgtncccagaggagttatgcaaagggaagctggacaggcggtctgtgctctggcaaagaaatttcaataccgtgcacaattctggtggtggaggaaccactgatagatc

SEQ ID NO: 59245 - DNA, 398 bp, Homo sapiens
gagtcttgctctgccgcccaggctggagtacagtggtgtgaacttggctcacagcaacctccacctcccagattcaagtgattctcctgtctcagcctcctgagtagctgggattacaggctcccgccaccctgcctagttaatttttgtatttttagtagagacagggtttctccatgtttgccaggctggtctcgaactcctgacctcaggtgatccgcctgctttggactttcaaagtgctgggattacaggcatgagccaccgggcctggctttccctagagtattttaaaacaacctagacatctgcatgcatctctgactgagaaggactgctttccctttaacataaccacttgccattattatatctaacatttacaatcattctttatg

SEQ ID NO: 59246 - DNA, 453 bp, Homo sapiens
  misc_feature (8)..(8): n is a, c, g, or t
  misc_feature (14)..(14): n is a, c, g, or t
  misc_feature (18)..(18): n is a, c, g, or t
  misc_feature (159)..(159): n is a, c, g, or t
  misc_feature (450)..(451): n is a, c, g, or t
cttcgtcnaatgcnacgnagagcatatcagtttttaaaaaggaactgaattagatatgaatgaagaaataaagtaggctggtgttttgggggaaaaaatggacatctgttattagattacaaaagaagtttatggaattagaatcaacactaaatgaancaaaagaagaatttacgtcaggtggacctcttggtcagaaacaagacccaaaagaatgggtattttctgccagaaaaatacacattgagtggtcacaggagtccaatcattcgagtcattttccatcctgtgttcagtgttatggtctctgcttcagaggatgctacaattaaggtgtgggattatgagactggagattttgaaagaactcttaaaggaaggacacacagactctgtacaggacatttcatttgaccacagtggcaagtttctggcttcctgttctgcagnnat

SEQ ID NO: 59247 - DNA, 206 bp, Homo sapiens
ttatcttacaattctacttcccagcatcctgaaattttcaaatactgtcttagtatattaaactcttttgaaatagataacaaaagcaccatgggagtccgttgaaaacttaggtttgttccttgctaaaatttctaagtccttcattatgactataaagaaaaaaggttcatcaattcaaaaaaaaatcctgattcttcaaaata

SEQ ID NO: 59248 - DNA, 311 bp, Homo sapiens
ttaaaaatactctggaaagagcacttccatcgttcatttacatcatattagaaatggatttccgagtcagcactggcttcctccagaatagcagtcctggaggagcgagatctccccaagcctccaggattgcagtctgttttgtgccttcactccctaataggtttgccttatttaaaggacccaccttcagagctgccaaggactttctcagagcagctccttggtccctccgacagcctgggatggcatttattctggggcctgggtgtggggaggtcctcaccagcctaggagtaagaggaggtggt

SEQ ID NO: 59249 - DNA, 395 bp, Homo sapiens
ttgtctcttttatagaaaatcaataggttttgaggcttttaggtcttggtcttttggatcttcataactgagtctcctgttgttcgttttgcttgtctattttgtaattgctttgtggactgaagcttgttttgaactttatgggagacttgatagtgtgatctgcctcaggaccaacagtttatgtaaaaggtgagctgacagcaactttatgtttttcattggaaagtttagtccatttatagtaaacgttattattgataggtaagaacttactcctcccattttggttatttgttttctggtacttgtggtcttctcttcctccttccttcctgtcttcctttgtgtaaagagatttctctggtagtatgtctaattcaagctttactttc

SEQ ID NO: 59250 - DNA, 239 bp, Homo sapiens
ccagcaggaaggggaggggggaataaagggaatgggtgttttggaagccacattcaaaaacaaaaactgtcccaaatagcagaaagcagtcaaaagtatcaaatgcagccgaaaggtcacgaaaggtgattttggcgacagaagatgctggagataaagactgtggtggaggaagggcctgagggccacagtgtaagtgacatgctgaagactctagagtctggctagtgtgctttccc

SEQ ID NO: 59251 - DNA, 1434 bp, Homo sapiens
ccgccccaggaagagggagggaggaagcggcttgccggagagccagggcgcagtgggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccgccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgctacgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcgagccca

SEQ ID NO: 59252 - DNA, 679 bp, Homo sapiens
tcggcctccaccttctttggcggctctcggagcagcggctcggcacgcagagctcgcgcccacgacgtggagatggtgggccagcttgtcggtatcatggtggtgtcgtgcatctgctggagcccaatgctggtgaggggcgcaccggcccctcgagccacgctccttcccgctccctctcggcaccctcccgccctttgtcgtcccaggacacctggggcctccatcctggactcaaccaaggccccggcccctagaggccccacctgccccgaaagccagcatcgccttctccatctgacctcccatccttcctcctagcccccctctcctcttcctttttggggtctttgtagcgcaccccgacccacacaagcctcctctcctgccccaccgttataagtcgccgcgcttcattccctagtcctttcacccaacccccttgcttttcctctttccgggacacctgagactcctctacggccggacccccacccactgaaggtgtttgtttctttgccccccttttttttccgcatccgtttctcatctggatccccatttaccctccctgcgacggctcgcccctcctcccaggcttttaccttccagccacgcccccaccatccctgcgcccccctgcgcccgcgcctgctctatagctcacaccggcttcccc

SEQ ID NO: 59253 - DNA, 1357 bp, Homo sapiens
ccgccccaggaagagggagggaggaagcggcttgccggagagccagggcgcagtgggcggcagggctgagcggccggtgatggggaccccacatcccaggcagtgccggcacccctggcgcctgacatgagcccttgcgggcccctcaacttcgcccgcgctgcccatcttctccatgacgctgggcgccgtgtccaacctgctggcgctggcgctgctggcgcaggccgcgggccgcctgcgacgccgccgctcggccgccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgctacgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcgagccca

SEQ ID NO: 59254 - DNA, 616 bp, Homo sapiens
acaaacgtcttgtgtttatgtcacttagaggggtgcatggataagacattttccacaacaggaaatatgtattgggctctaacaccatgtccgtcactcgtctttctaggacccgaggccttacacatagaccgtgccctcaaaacttggggtctgtcttgtggaataaaaggggtgacttcaagaacaccagtctttatcagccacttggtgtttgaaggtatagtcttggcctggagaaagccacagcaccagcctcccctgcatccccagtatcttactctgtaaaatcagaatatgaaaactttgctacccgcctactacctctggggggttgtggaggagattgctaagttaatatttgaagaggttcctttaatgaaaggacaaaaggctatttttatgcctatctccatgtgtggctgcagatataattagcggtcataaagttatccagccctgaatggaaatcaactggagcattttcctggcggatgcgtttgtagttgaaatgccacacacagaggcggggctgcttctggaaggagcacctttcgttgactgtctcagtttctcagtggaaggggggagtttattcagggaaggaaacagatgc

SEQ ID NO: 59255 - DNA, 853 bp, Homo sapiens
tcagaatctttcagatcactgcagatgaggaatgggaagcccagactagggatgtgacctacccagggccacacggcttgcttgcggcagaactaggagttaggagtggccccctagcccttgtctctcattcctgggttcagcccaccagctcaagctgctttttgggcatactggaagacaagccctgcacaccttagcctcctaccagttcccatgtgtctttgtccttttccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaa

SEQ ID NO: 59256 - DNA, 3229 bp, Homo sapiens
ctgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaa

SEQ ID NO: 59257 - DNA, 3217 bp, Homo sapiens
ctgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcaggatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaa

SEQ ID NO: 59258 - DNA, 2884 bp, Homo sapiens
ctgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcaggatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccaggtgagagtgagaggtgcttgaatttgcaaagaggattttacctggttcaaatgacccctggactccatctcattatcttccacaccatctcagatctgaacttaacagagcctctgcccttaaagtgcacaaaagtcaatcaaagagatgaataatgacattagtaatgacagctaatatttcttgagcactttcaatgtgacagacaccatgtgtgttcagcaatttacacatttacattttccccctgtaatgtttcccaaagccctattaaatagggta

SEQ ID NO: 59259 - DNA, 1468 bp, Homo sapiens
agtctgagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagaggaaaaccataagggttaaaatagtagatgaggaggaatacgaaaggcaagagaatttcttcattgcccttggtgaaccgaaatggatggaacgtggaatatcaggatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaa

SEQ ID NO: 59260 - DNA, 1363 bp, Homo sapiens
agtctgagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaa

SEQ ID NO: 59261 - DNA, 1481 bp, Homo sapiens
cccctgggattggctactttaagttcagagtacgcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 59262 - DNA, 1413 bp, Homo sapiens
cccctgggattggctactttaagttcagagtacgcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 59263 - DNA, 1335 bp, Homo sapiens
cccctgggattggctactttaagttcagagtacgcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 59264 - DNA, 834 bp, Homo sapiens
  misc_feature (612)..(612): n is a, c, g, or t
  misc_feature (634)..(634): n is a, c, g, or t
cccctgggattggctactttaagttcagagtacgcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggtgtncttcagagatactgcaggttcngttccagaccactgcaataaagaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggtgattatagtcaataataacttaattgtactt

SEQ ID NO: 59265 - DNA, 2470 bp, Homo sapiens
ataccaggaacatccactgttatccattgtaacagggatttaggcagattatatgattggaaactttagtggtgaaagaatgagtaagttctcttttgattgcttttatattctcaaatgaaaaaagaaatgaagttactggttgagagtggcagaaggggttgattgagcctagaaaacatagaatagtttttaacctcagtaagtaaattgattaagggaggtgttctgggattacatgacagtgtcaggggttttgtgaaaatttaaagagagaccagccatcatggttatgtatgttttttcagtcttgttcagcccaagcactgaataaattggaaagttgcatttatccatggttggggatttggtaaatactatgaaggtaagaaaaacaaggacaagtgcacctgctagaaaacagcggcagacatggtagatattaatccaactatctcaataatcactttaaatgtgaatggcgctaaatataccaactaaaacacaaagactgccagtagattaaaaaaaaaagacccaatgatatgttgtctgtaaaaaaacccattttaaatataaagacacaaatagcataaaaataaaggtataaagaaagatataccatgttaatactaatcaaaagaaaactggagtagcagtattgatatcagataaggcaaacttcagagggagaaaaatgatcagggataaagaggggcattatataataagagggtcaatactccaagaagacattgttaaatccttaatgtgtatgcacctaacaacagagcatcaacgtatgtgaagcaaaaactaatagaactgcaagagaaatagacaagtccactattatagttggagacttcaacactcttctatcagtaattgacacatttagcaggcaaaaaaatcagtaaggatatagctgaactggacaatactgtcaagccactgaatctaattgacatttacagtatacttcattcaacagagtacatattcttctcaagctcacaggaaacatccaccaagatagactacatacttggccttaagatacaccttacaaatttcaaagaatacaaaccatataaagtgtgctctcagaggaaattaaacaaaatcaaaaacagaaacgtagatgggaaatctcaaaataactggagattaaacaaaacacttctagataccagatgggtcaaagaagaagtctgaacagaaattttaaaatgttttgaactaaataaaaatgaaaatacaatgtatcaaaatttataggaagcagtgaaagtagtggttggagataaattataatattgaatgcctatattagaagagattaaaaagatttaaaattcataatctaagtttccatcttaggaaactagagaagaaagatcagtgtaagcctaaagcaagcaaaaggatagaaataaaaattatagtagaaatcaataaaatagaaaacaagaaaccaatagaaaaattcagtgaagtaaaaatgtgctaatttgtgcagcagcaatagaaaaaagaaataaaaacagtactttcacaggtcagtaaaatgtataaacctctagctaagctaactaagaaaaaaaaacacagattgctgataacagaaatgagaaaggggtcatcactactgatcccaaggacattaaaaagataacaaaagaatattatgagcaactctgtacccacagatttgacagcttaggtgaaacagatcaatttcttgaaagacacaaacaaccaaaactcacacagggaaaagagatgatctgaataggcctatatctattatggaaattgataaattatggaagtcaataaacaaccttgcaaacaagaaagcaccagacccagtggttttgttgtcaaatctagcaaacattatggaagaaatggtaccaattctctacattctcttcccaaaaaatagaagtgaagggaatacttcctaactcatttcatgaagttagcatttcctgtatcaaaatcagataaaaacattggaagaaaggaaaactacagaccaatacctctcatgaacgtagatcagcggtctccaacctttttggcaacaggtaccagttttatggaagataatttttccatgggacatggtgggtggggcagatggtttcgggatgaaactgttgcacctcagatcatcaggcattagttagattctcataaggagcttgcaacctagatccctcatatgtgctgttcacaatagggttcacactcctgagaatctaatgtgtcgctgatctgactagaggcagagctcaggtggcaatcctggctcacctgccactcacctcctgctatgtggcctgatactgttactagtcccaggcctgagggttagggatccctgatataaatgcaactattagcaaaatattagcaaattgaatttatgaataaatgtgaatctgtgaatacaccacaa

SEQ ID NO: 59266 - DNA, 2256 bp, Homo sapiens
ataccaggaacatccactgttatccattgtaacagggatttaggcagattatatgattggaaactttagtggtgaaagaatgagtaagttctcttttgattgcttttatattctcaaatgaaaaaagaaatgaagttactggttgagagtggcagaaggggttgattgagcctagaaaacatagaatagtttttaacctcagtaagtaaattgattaagggaggtgttctgggattacatgacagtgtcaggggttttgtgaaaatttaaagagagaccagccatcatggttatgtatgttttttcagtcttgttcagcccaagcactgaataaattggaaagttgcatttatccatggttggggatttggtaaatactatgaaggtaagaaaaacaaggacaagtgcacctgctagaaaacagcggcagacatggtagatattaatccaactatctcaataatcactttaaatgtgaatggcgctaaatataccaactaaaacacaaagactgccagtagattaaaaaaaaaagacccaatgatatgttgtctgtaaaaaaacccattttaaatataaagacacaaatagcataaaaataaaggtataaagaaagatataccatgttaatactaatcaaaagaaaactggagtagcagtattgatatcagataaggcaaacttcagagggagaaaaatgatcagggataaagaggggcattatataataagagggtcaatactccaagaagacattgttaaatccttaatgtgtatgcacctaacaacagagcatcaacgtatgtgaagcaaaaactaatagaactgcaagagaaatagacaagtccactattatagttggagacttcaacactcttctatcagtaattgacacatttagcaggcaaaaaaatcagtaaggatatagctgaactggacaatactgtcaagccactgaatctaattgacatttacagtatacttcattcaacagagtacatattcttctcaagctcacaggaaacatccaccaagatagactacatacttggccttaagatacaccttacaaatttcaaagaatacaaaccatataaagtgtgctctcagaggaaattaaacaaaatcaaaaacagaaacgtagatgggaaatctcaaaataactggagattaaacaaaacacttctagataccagatgggtcaaagaagaagtctgaacagaaattttaaaatgttttgaactaaataaaaatgaaaatacaatgtatcaaaatttataggaagcagtgaaagtagtggttggagataaattataatattgaatgcctatattagaagagattaaaaagatttaaaattcataatctaagtttccatcttaggaaactagagaagaaagatcagtgtaagcctaaagcaagcaaaaggatagaaataaaaattatagtagaaatcaataaaatagaaaacaagaaaccaatagaaaaattcagtgaagtaaaaatgtgctaatttgtgcagcagcaatagaaaaaagaaataaaaacagtactttcacaggtcagtaaaatgtataaacctctagctaagctaactaagaaaaaaaaacacagattgctgataacagaaatgagaaaggggtcatcactactgatcccaaggacattaaaaagataacaaaagaatattatgagcaactctgtacccacagatttgacagcttaggtgaaacagatcaatttcttgaaagacacaaacaaccaaaactcacacagggaaaagagatgatctgaataggcctatatctattatggaaattgataaattatggaagtcaataaacaaccttgcaaacaagaaagcaccagacccagtggttttgttgtcaaatctagcaaacattatggaagaaatggtaccaattctctacattctcttcccaaaaaatagaagtgaagggaatacttcctaactcatttcatgaagttagcatttcctgtatcaaaatcagataaaaacattggaagaaaggaaaactacagaccaatacctctcatgaacgtagatcagcggtctccaacctttttggcaacaggtaccagtgtttgatgaagctaggactgaggagcaagcgagcaagcagcagttcgtggtgaagataggaaaagagtccaggagccagtgcgatttggtgaaggaagctaggagaaggaaggagcgctaacgatttggtggtgaagctaggaataggattg

SEQ ID NO: 59267 - DNA, 1235 bp, Homo sapiens
ataccaggaacatccactgttatccattgtaacagggatttaggcagattatatgattggaaactttagtggtgaaagaatgagtaagttctcttttgattgcttttatattctcaaatgaaaaaagaaatgaagttactggttgagagtggcagaaggggttgattgagcctagaaaacatagaatagtttttaacctcagtaagtaaattgattaagggaggtgttctgggattacatgacagtgtcaggggttttgtgaaaatttaaagagagaccagccatcatggttatgtatgttttttcagtcttgttcagcccaagcactgaataaattggaaagttgcatttatccatggttggggatttggtaaatactatgaaggtaagaaaaacaaggacaagtgcacctgctagaaaacagcggcagacatggtagatattaatccaactatctcaataatcactttaaatgtgaatggcgctaaatataccaactaaaacacaaagactgccagtagattaaaaaaaaaagacccaatgatatgttgtctgtaaaaaaacccattttaaatataaagacacaaatagcataaaaataaaggtataaagaaagatataccatgttaatactaatcaaaagaaaactggagtagcagtattgatatcagataaggcaaacttcagagggagaaaaatgatcagggataaagaggggcattatataataagagggtcaatactccaagaagacattgttaaatccttaatgtgtatgcacctaacaacagagcatcaacgtatgtgaagcaaaaactaatagaactgcaagagaaatagacaagtccactattatagttggagacttcaacactcttctatcagtaattgacacatttagcaggcaaaaaaatcagtaaggatatagctgaactggacaatactgtcaagccactgaatctaattgacatttacagtatacttcattcaacagagtacatattcttctcaagctcacaggaaacatccaccaagatagactacatacttggccttaagatacaccttacaaatttcaaagaatacaaaccatataagggtggccccagggaatcacccatccaaacgaacgtcatgcgaccccggggataacctctgaaccatgggccacagtgccgcattaggcggcgcaacaagacacgccgccacgcggacacagggggaactggggcgcg

SEQ ID NO: 59268 - DNA, 692 bp, Homo sapiens
cgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcgctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacaacccgtgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 59269 - DNA, 811 bp, Homo sapiens
aaccagaaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcg

SEQ ID NO: 59270 - DNA, 1223 bp, Homo sapiens
aaccagaaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctgtgtccgcgcccgcacccgcgctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacaacccgtgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 59271 - DNA, 387 bp, Homo sapiens
aaccagaaggcctgggggcgaggaacaagacctcggagtatttcaaggggagacctagttccctgccctgccccgggcccagggcgccgcggtctgaactctgctcggctggaggactcggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 59272 - DNA, 398 bp, Homo sapiens
agactgccctggacctcttgaagcttagctgggacactcgccagccctcagctccctttcctattaagtggccacagccctgccctaaactgcctttgggatattccaatatagccttcagaagcttccctattcatatggggacagggaggccctagaagggctagaggcctggtcccattgctgggctttgctgactctaccctcccccactaggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaa

SEQ ID NO: 59273 - DNA, 1267 bp, Homo sapiens
  misc_feature (6)..(6): n is a, c, g, or t
  misc_feature (8)..(8): n is a, c, g, or t
tatggntntgagtacctgggaaactccccccggctggtgatcacacccctcaccgaccgctgctacaggacactgatgggagctttgaagctgaaccttgggggtgctccagagggtccagctgggactggcaagacagaaaccaccaaagatttggccaaagccttggctaagcagtgtgtggtcttcaactgctccgatggtttggattacaaagctatggggaagttcttcaaggggctggcacaggctggagcatgggcgtgctttgatgagttcaacaggatcgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaa

SEQ ID NO: 59274 - DNA, 1888 bp, Homo sapiens
ggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaagcaataatttaatgattgaaacttaat

SEQ ID NO: 59275 - DNA, 1834 bp, Homo sapiens
ggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaattctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaagcaataatttaatgattgaaacttaat

SEQ ID NO: 59276 - DNA, 380 bp, Homo sapiens
tatgtgtggaatataaaaaagtcaaactcatagaaacggtatagtgctggttaccagcggttgggaggattgggagatgttggtgaagggatacaaaattttataatagactggtggaataagttcaagagatctgttgtacaacatggtgactatagttgataacaatgtattgtgtacttgaaaattagtaaattttaagtattctcaccacaagtggtaaatatgtgaagtaatgcatatgataattagctccatttagctgttccacaatatgtacatatatcaaaacatcgtgctaaacattgtaagtatatacagttttctaaaaaaggattagttgagtcttaactcaggtctctctgactcttcaagttgta

SEQ ID NO: 59277 - DNA, 364 bp, Homo sapiens
atctggaggctgactctagaggatacacccaccgccagggagtactacgttgcccgggctagcctcaaactcctgagttccagggatcctcctacctcagcttcccaaagtggtgagattacaggatcgagccatcgcacctggcccaattattctttctaaaccatttcctcttctgtgttcatgcctttaaaaataaaatttaaaaaaaaaaaaaaaatccttaaaatttctcaggtgttttccatatcattttattatcaagaatatggctaatcagaagtcacagccagcccccgaactacaactacaaaacatgcatattataggctacactgagggatttctgaggttagcagatgca

SEQ ID NO: 59278 - DNA, 1974 bp, Homo sapiens
  misc_feature (776)..(776): n is a, c, g, or t
ggttccgcggggctggcgggcgagcgggcggccgggatcggcggcggcggcggcggcggcggcgcttgacagacaatgagggcggcggggcggcgttgagcggcggcggcggcggcggcggcggcgagcgacgcggggcccgggggcggggcggggcgccagccatggacaatcagtgcaccgtccaggtgaggttagagctggggcatcgcgcccaactgcgcaagaagcccaccacggaggggttcactcacgactggatggtgtttgtccgcggccccgagcaatgtgacatccagcacttcgtggagaaggtggtcttctggctgcacgacagcttccccaagcccagacgcgtgtgcaaggagcccccctacaaagtagaggagtcggggtacgctggcttcatcatgcccatcgaggtgcacttcaaaaacaaggaggagccgaggaaggtctgcttcacctacgacctgttcctgaacctggaaggcaacccgcccgtgaaccacctgcgctgcgagaagctcaccttcaacaaccccaccacggagttccggtacaagctcctgcgggccggcggggtgatggtaatgcccgaaggagcagacacggtgtccaggcccagtcccgactaccccatgttacccacaattccactctctgccttctctgaccccaagaagaccaaaccatcccacggctccaaggacgccaacaaggagagcagcaagacctccaagccacacaaggtgaccaaggagcaccgggagcgnccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaaccctgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgagtctgcccagtcaagcccgtccaactccagctccagctcagactccagctcagactcagacttcgagccatcccagaaccacagccaaggacccctgcgctccatggtggaggacctgcagtccgaggagtccgacgaggacgactcttcgtcaggcgaggaggctgccggcaagaccaacccggggagggactccaggttgagcttcagcgacagcgagagtgacaacagcgccgactcctccctgcccagccgtgagcccccacccccccagaagccacccccgcccaacagcaaggtgtcaggccggaggagccccgagtcctgcagcaagcctgagaagatcctcaagaagggcacctacgacaaggcctacacggatgagctggtggagctacaccggaggctgatggcgctgcgggagcgcaacgtgctgcagcagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcttcatttggatatcagagctatggctcagaaaagcaagcatct

SEQ ID NO: 59279 - DNA, 664 bp, Homo sapiens
ggttccgcggggctggcgggcgagcgggcggccgggatcggcggcggcggcggcggcggcggcgcttgacagacaatgagggcggcggggcggcgttgagcggcggcggcggcggcggcggcggcgagcgacgcggggcccgggggcggggcggggcgccagccatggacaatcagtgcaccgtccaggtgaggttagagctggggcatcgcgcccaactgcgcaagaagcccaccacggaggggttcactcacgactggatggtgtttgtccgcggccccgagcaatgtgacatccagcacttcgtggagaaggtggtcttctggctgcacgacagcttccccaagcccagacgcgtgtgcaaggagcccccctacaaagtagaggagtcggggtacgctggcttcatcatgcccatcgaggtgcacttcaaaaacatttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaa

SEQ ID NO: 59280 - DNA, 1627 bp, Homo sapiens
  misc_feature (429)..(429): n is a, c, g, or t
actttgaacatcctcagcactctctccaatggcaatagttctaagcaaaaaattccagcagatggagtccacaggatcagagtggactttaaggaggagccgaggaaggtctgcttcacctacgacctgttcctgaacctggaaggcaacccgcccgtgaaccacctgcgctgcgagaagctcaccttcaacaaccccaccacggagttccggtacaagctcctgcgggccggcggggtgatggtaatgcccgaaggagcagacacggtgtccaggcccagtcccgactaccccatgttacccacaattccactctctgccttctctgaccccaagaagaccaaaccatcccacggctccaaggacgccaacaaggagagcagcaagacctccaagccacacaaggtgaccaaggagcaccgggagcgnccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaaccctgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgagtctgcccagtcaagcccgtccaactccagctccagctcagactccagctcagactcagacttcgagccatcccagaaccacagccaaggacccctgcgctccatggtggaggacctgcagtccgaggagtccgacgaggacgactcttcgtcaggcgaggaggctgccggcaagaccaacccggggagggactccaggttgagcttcagcgacagcgagagtgacaacagcgccgactcctccctgcccagccgtgagcccccacccccccagaagccacccccgcccaacagcaaggtgtcaggccggaggagccccgagtcctgcagcaagcctgagaagatcctcaagaagggcacctacgacaaggcctacacggatgagctggtggagctacaccggaggctgatggcgctgcgggagcgcaacgtgctgcagcagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcttcatttggatatcagagctatggctcagaaaagcaagcatct

SEQ ID NO: 59281 - DNA, 364 bp, Homo sapiens
ctaccccatgttacccacaattccactctctgccttctctgaccccaagaagaccaaaccatcccacggctccaaggttagtgaggcggaaggcccagtcgcgtgggagcgccggggcccagctgtggtgggtctggccccggcgccctccctccactgggctgggccttccgcacctgctcgctcccttggcgtcttcctctttgagctctctgcacacccctcgctgcgcactgccgcttccctaggatttcaggaataagcccgtgatcatgggctctttgccctgttcatcttgaggccagagaccctgcctagtcctctcccgttctgccaagtgatggcagggccccaggactgctcg

SEQ ID NO: 59282 - DNA, 438 bp, Homo sapiens
gatgtggtggtgttcctctagttccagctaccagagaggctaaggcacaagaattacctgagctgtgggaaccagaggttgcagcgagccaagatcatgccactgcgctctgccctgggcaacagagtgagactccatctcaaaataaataaaataaaattccatttgtgagggaaaacttaactatctaaattaacgaatgtaaatttagttgcagtgatagtctcgtgtcaaagaaaagacaaatctcatgtaaaaacaaatagtaagagagaataatttcttggccatctctaacactgatggaaaggctgagcatatgtttaatgaattgtcacagaattccctgttcagatggacactgctttctcaaattaaacttgttattccttaattacagcagtcacaggaaataaagcactatctctcaggcaatat

SEQ ID NO: 59283 - DNA, 265 bp, Homo sapiens
ggcattttcatcagatgttcatggctggaccatgtaaacatgtacaagtcattttttccagctgatgaaatgaaagctaagactgagcctttgtcggttcccctgctgcctcaaaacttgtatttctggtgactgtataaggaatgtggctcctggctgaagttgactctctctgtggctgggcccactgggcatacttgagaagaaagcaaggagaacacatggaaagattttcaaagaaaagttatgaagttcattttcactg

SEQ ID NO: 59284 - DNA, 614 bp, Homo sapiens
caggcgccaaggctctggcagttggccagcacaccactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59285 - DNA, 513 bp, Homo sapiens
caggcgccaaggctctggcagttggccagcacaccactacgcatgtgtgtcaactctagggttgggtgctggggttgcggctttcggttaacaccgcaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59286 - DNA, 1414 bp, Homo sapiens
  misc_feature (690)..(690): n is a, c, g, or t
  misc_feature (704)..(704): n is a, c, g, or t
  misc_feature (706)..(706): n is a, c, g, or t
  misc_feature (714)..(714): n is a, c, g, or t
  misc_feature (716)..(716): n is a, c, g, or t
  misc_feature (724)..(725): n is a, c, g, or t
  misc_feature (751)..(752): n is a, c, g, or t
caggcgccaaggctctggcagttggccagcacaccactacgcatgtgtgtcaactctagggttgggtgctggggttgcggctttcggttaacaccgcaggtgaggtcgttaaactgtgtattgcgactcggctcctatcggaccgtgaaggctaagaaaggcttcacagttcccactcttttggtctagccttagcaacaggtggactagagaggcgggactccagccagcacatgggggaaagacctgccggcttggcgcagggtgaagtgggagttgtagtcttaccgggccggactgcgcagcctttttccgggcacactgggagttgtggtttatcgcctctggactaatggctgtatgtggacttttcccttcttaggaaatgctttcagtgaggctgtgagcagtaccggagggtgatggcttgcgtttccttaagttatcctatctaaaatattttcccaagtatttccgccgggcgctgtggctcacgcctgtaatcccagcactttgggaggccgaggcgggtggatcacctgaggtcaggagttcgagaccagcgtggccaacatggcgaaaccccgtctctactaaaaatacaaaaattagccgggcgtggtggcgcgcgcctgtaatcccagctactcaggaggctgaggcaggagaatcgcttgaaccctggaggcngaggttgcagtgancngagatcgngncactgcannccagcctgggtgacagagcgagactnngtctcaaaatataaaaagaaaaaaaataagggatcttccaaaaggaaaaggtgaccagtcgagaaatctgggaaaacccaactggttagtgggaaagagtacaacgccggggacacggagggaacgattacatctaagatcagtgagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59287 - DNA, 873 bp, Homo sapiens
caggcgccaaggctctggcagttggccagcacaccactacgcatgtgtgtcaactctagggttgggtgctggggttgcggctttcggttaacaccgcaggtgaggtcgttaaactgtgtattgcgactcggctcctatcggaccgtgaaggctaagaaaggcttcacagttcccactcttttggtctagccttagcaacaggtggactagagaggcgggactccagccagcacatgggggaaagacctgccggcttggcgcagggtgaagtgggagttgtagtcttaccgggccggactgcgcagcctttttccgggcacactgggagttgtggtttatcgcctctggactaatggctattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59288 - DNA, 678 bp, Homo sapiens
caggcgccaaggctctggcagttggccagcacaccactacgcatgtgtgtcaactctagggttgggtgctggggttgcggctttcggttaacaccgcaggtgaggtcgttaaactgtgtattgcgactcggctcctatcggaccgtgaaggctaagaaaggcttcacagttcccactcttttggtctagccttagcaacaggtggactagagaggcgggactccagccagcacatgggggaaagacctgccggcttggcgcagggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59289 - DNA, 772 bp, Homo sapiens
caggcgccaaggctctggcagttggccagcacaccactacgcatgtgtgtcaactctagggttgggtgctggggttgcggctttcggttaacaccgcaggtgaggtcgttaaactgtgtattgcgactcggctcctatcggaccgtgaaggctaagaaaggcttcacagttcccactcttttggtctagccttagcaacaggtggactagagaggcgggactccagccagcacatgggggaaagacctgccggcttggcgcagggtgaagtgggagttgtagtcttaccgggccggactgcgcagcctttttccgggcacactgggagttgtggtttatcgcctctggactaatggctgcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 59290 - DNA, 867 bp, Homo sapiens
caggcgccaaggctctggcagttggccagcacaccactacgcatgtgtgtcaactctagggttgggtgctggggttgcggctttcggttaacaccgcaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaaaaaaaaaacaaaaaaaaaaaaaagaaaaaaaaaagagaacaaagcaaacaaaaaaacacagcgaaaaagagaaaaaaaaaaaaagggggggggggcccgaccaaaaaactactccggcggggaggccacgaacggagctgcagcagacccccattctgtcggtgacgagcaggggccccacacagagagcgagggccataaaaaacagagcgagcgaacgcgggacgccccatatcacacacgcactgctcggtgggaggcaacacagctgctcgcggcgacgatactatgtagagcgaaagaccacccacccgggccggggggagaacatcgaacgcgcagcaccacaccata

SEQ ID NO: 59291 - DNA, 665 bp, Homo sapiens
attggggccttactatgatgcctaattctacattaaactgatgtcagtcatgtcattcatttcatccagtttacttgtttacataataattctgaatgtgagctagataagcatctgacctgacattttttaaaaaatggctccatgatcttatgttttggttaactagcataactttatctagcttaacttctctaaaccaggtatctatttttaatctgtgtacttctcagctggagacatttgacaacatttgcaggtatttttagttatcacaacagggggagggctgctaccagcacctagaggccagggatggtgacaagcatcttatagcatgcaagatagccctccacacgaaagaatgatcagacccacaatatttatagtgccaaggttgagaaaccctggactagataatcattaagatcttgccttactctaaaggattgtgattatttttttaagttgccataataaagaataaatacatattcagaacatacctggcaatgtagtcataaacatctgttctaaggtatgtttaaccaaggagtgatggtgcaaagttttacatttcttattccccaatagttttcaatccagtatttttgttgcatgataaatattctataaatttcacacacaaatatatggcctttcaa

SEQ ID NO: 59292 - DNA, 320 bp, Homo sapiens
tcttcaatcctcactactatggggactgtgtcagggagtggggcatgggctttggtgtcaaatggtcctggattcaaatcttggctgcttctctacttggccgagggaacttgagtgtccagcttctttatttctctgagcctcagaaccctcctctgtaaaaccaggaccatcacaggcccagccttacaggactgctgggaatttgaggagctcccaaaaactacccaaagtagctcctggtgtatagaaagtgctcagtggatgatgcgatgatgtttttttcccccttgcctgacatcctcattttacaggcaaga

SEQ ID NO: 59293 - DNA, 307 bp, Homo sapiens
acaacagacacccaagtattcctaaatgacatgtttttttgtgtgttctccattttgaatttgttatacgtttagtaattttacctttgtctggaacttttgtctggaacctttttctcctcttctttaacttgtctaattcgaaatgcctccttcacttattacctaagagcctgaaaatatgcaagtggtcgggtttggtaatcttgcaatttgtaagcttctttgccctttcatattttggggtttttcttcctcatatatctctctcaagatttttgctcagtgccaggtactttgggggtat

SEQ ID NO: 59294 - DNA, 406 bp, Homo sapiens
ctttttcttaatatattaatatttaccaaggcaagacagtgatttatggacatttaaattagtttagctttgttctgctgttctaaaacattgtgtactgtctgatagacttttaaaaaacagtgcttttccaggatgatttatgatatgcagtattgtttatagatgcccatggcttaaccttgaaaagtcaattaagtgacacaattaagagagatatgaatagtggtagaaaaagcatgtactctggataagtgggggtaaatctagtatttgttattcctgtcagtaatattgtcattagtattttttagaggtttattttttatggttataaattcatgtcactcttctgcaatggttacatcagtggaatgcagaaattatcatgctttggggattaaaa

SEQ ID NO: 59295 - DNA, 498 bp, Homo sapiens
gaaaattatggataatgaaagaacttaagatttttagaacgagtaagagcaaaatcacagcgaaattaagcagttttagtatgtcacattatcctaaagaggatgaagagcctggattatgtaatggggtagtaagaatgacaaagttatatgatttagtggaagagattgcaagggatagttctatagcttctatttaaataggtcactgataaatacattatgtctttctgttaaatctgtattaggaaattctgttcataattccttctaggaatttctgtgtgttatgttcagttttcagtggaaaagtttcaaataataaaaatactacatacctatactagtttctgcttgttctgtttgtatactttaactttttttagaatataatacaaccttattgctaaaaaccacaactggtaagatatcttgggtaaataagccttactattgcccctaaccttaccttaattttcaatcaaaagactaacaaag

SEQ ID NO: 59296 - DNA, 687 bp, Homo sapiens
tccttgcaaaagttgttcacccacaagagacagattttgtaaaatttaaaatgtagctaattttccatgtgattaggcagtgtaatttaaagaaactcaagattttctacaaataattttttgaggcaagaagatgctaaagtcacttgtactgccactaaactttactaaaagttggtttgaacactttaattgcttttgaatagatgattgaagctgtgaagaggtggcagcagctgacatgttgccatggtagcatttcctccccagctgaggaggctatacagaagaaaggatataggtcagaaagtgtttatactgacaaaacaaccacattttaaaatcaaatgcttttgtaaacatccataagccaaatgagagttgtgaaatctagtttcaggatattaaagacagactgatttatctttaggatgatgtatcaagctgtactgtgagaatggagcattcaaggtcaagaatactctccttcctgcatattggcaattcaattttaaaagattgaaacacgatgaaagtgtttctatcagtttcttctgtgttccttgcaataaggatatatttaattgaaaaattcttcttgaaggtagttcatctctgaataaactactccagggtaaggaagatcaactctatgatcaataaatatctgttggttaattagtcttg

SEQ ID NO: 59297 - DNA, 202 bp, Homo sapiens
tttttacactgcctcctagaagcttgcattttacaacaattggaaaatcagaaaaagaacaaagatgctgcacaacacctggaccacaagaagtttcctcctttccttcagatgtgcacagcgacctttgaacagtagccagtgcatttagagagctctacttcacagtgaaacatggggcctcaggccctgatcacatttt

SEQ ID NO: 59298 - DNA, 1605 bp, Homo sapiens
ctcccggagcagaaccgctccccgccggctgtccgcaacctccgccagcgtcggtccctgggcaggtgtgggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaac

SEQ ID NO: 59299 - DNA, 992 bp, Homo sapiens
ctcccggagcagaaccgctccccgccggctgtccgcaacctccgccagcgtcggtccctgggcaggtgtgggtgagactgctcgttcgtttctttaaatttcgatgccattggggagggtggaagggaaatgcaaaaaaaaaaaaagaagaagaaagaaacaagcagggtgtgctctatttcaaaaattcaatcctcagggctgaagctctcacgattaattaaaattaaatctccagtgcagctggaaaaagaaaggctgctgctcggcgccctcgctgcgcccgcctgccggggtcggacgtcggcgatgctgtggctccaggtgctgtgtgccgctggctgggaaggggagaaagggcaggcttagctgagggggagaaatgcggctttcagatcctttcatccttcgggagggagcccgggaaagagagtgaaggggaagaggagatgcggttgcagttttccacagaaccaagagaataaacgatttgaaaaaataaactcaggcccacctccgtctcacctcccactccccacccaagaatcaaggggaaagatcatctttaccaggtttgagacctgatccatttcagctgagctgcatagcgagtccagaagaggatctttccttgaagggtgcacgcttcctgcaagatgcatctgtaggtgtttgagatcatgtcctgtagttcattccttgtgcaggagggtgagcccgctgaggatggggaaaatttctcgtctgtgttatggtgcccagtaacagtgatttattattcagatctgctccttatttttcatcttgcttcccgctctgaacccaccagagtgagattacacctggactggcctactgagacttcaccctaagaacttggtcgaatgtgccagttgctgtggtcttaacaatccagatgggatgctatttctaaggctgttgtcagagtgttgcattttccccggacaggtattaaaataatataaaggcaa

SEQ ID NO: 59300 - DNA, 1905 bp, Homo sapiens
ctcccggagcagaaccgctccccgccggctgtccgcaacctccgccagcgtcggtccctgggcaggtgtgggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatg

SEQ ID NO: 59301 - DNA, 333 bp, Homo sapiens
acccatactggatggagtcttgaaacacgaggggaataagacagagaagaacgcgcccggtcttggggaggtataacacatatgcaataaggtgatgacatatcaccgttagataataatcgcagacaatgaagagtgtgtattcttctcagctcacatacaatctgatagcccagttcactcttccctccaatggtttttactccatcctctttctggtcccaccatcaattaccttggagacagtaggaaatgaaaaagaaaagaggtggaggtaagagagaggaaagacaagtgggaacccagggctcaactagtctgcacctcctcaac

SEQ ID NO: 59302 - DNA, 358 bp, Homo sapiens
ggaaaacatctcaggagattgtctatgaaaattaccccaacctctatagaaaggccaatgtttaaattcaggagatgccaagaactcctgtgaaatgctacgtgagaagaccatctccaagacacatagtcattagattctgcaagaaaaaaatattaaaggtaactagagagaaagatcaggttacctacaaagggaacctcaacaagctagcagtgaaccgttcaggagaaacactacaagccagaagagatcaaaggcctatattcagcattcttaaagaaaggaatttccaaccaagaattttatatccagcaaaattaagctttataagcaagggagaaacacgatcttttta

SEQ ID NO: 59303 - DNA, 233 bp, Homo sapiens
aaactataaaacattgctgaaagaaattaaaggagacataaacgggaacacatcgcatgttcatgtgttgaaaaacaatattgttaagatgtcagtactgctcagagcaattacagatttaatgcaagtcatgtcaatatcccaatgaaattttttgcagatatagaaaaacccattccaaacttcatatggaatcccaagggacattgaatagccaaaacaatgtataagaa

SEQ ID NO: 59304 - DNA, 520 bp, Homo sapiens
acgtgaaggaataaaaaattagaatatcttatttttggagaccctaatgagcatcagtggttgctaacatcacaaaaagacacaaccagatattacgtgccttgtgatggaagtattctgtgactacctgtcaagttattcctcccaccccatcaacaaaatggcaaacttaaatctgaacaggccttaagagctagctatcaattgacaggaaaaacagagacagaagaacatattaaccaataccacagagatgcaattagctaaatccaaaccaaggtacatcattaaaggccaaatggcccagtttcttcaacaaataaaactgcaagaaaaaaaaaaagtggagtctggggagaggggacagcagccccacaatttcatcagcaccccaaacttcttctatctttctgttcctccatcgtccttacagtgagactcccaccattatggtcaagagccagctgctacatctccagatactgtatccgtgtgtattccacgtctaggaaggaagaag

SEQ ID NO: 59305 - DNA, 346 bp, Homo sapiens
tggtcagggttatagcttagctcagcatgggtgcagacagattttcttactttttttttcatatcgcttctcagtatcatacctaagtgaagctgcaaggcatctaaggaacacaaactatttcagttgatctgtgagactgccagttcaagctattatagcaacaccttgagagtaaatggacatgtgtgcgtgtatcaatttttcaaagaatgatcacaaatactacccatattctcaagattaaataaataatctggccaaagtgctgggattacaggcgtgagccaccatgcccggtcctgatgtgatcatttcttgaggcagacattcccttttgttttgg

SEQ ID NO: 59306 - DNA, 387 bp, Homo sapiens
cttgtataaggatttaagactaaggctcagggacagcaaatattctatttgctaaaactaagccacatgcacacaccaagcaagagagccagggaagtggataggcacaggcagtcagtccacagaagaatgaatcaaagtgctgaactttcatagaaaaatctgttaagattcatgggtggtaaagaaaatacaaattaaaataacacaggaatgtcaccagaaaaaccatcaaataggtagcatttaaagatatctataggacttattgtttctagtgttctctcatatatttctggtgaagaataatttattgtagagctttttgaaacaatctgacaatttatattgcaattaattgtacttatgccatctgaccaaacaatg

SEQ ID NO: 59307 - DNA, 3574 bp, Homo sapiens
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctg

SEQ ID NO: 59308 - DNA, 3700 bp, Homo sapiens
  misc_feature (3577)..(3578): n is a, c, g, or t
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctgaannaaaaaaaaaaataaaaaaaaaattggggggggcccggggcccgaaaaaatttttaaaacacatggggggggggggggggccccagtgggtaagtgagacagggggcaaagggggtcccgagg

SEQ ID NO: 59309 - DNA, 3742 bp, Homo sapiens
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggtagtgatctgtgatatctgtaaatgtcaaaactgtattgttgaattctgcagccagcaaccgtacatactcattgtgtagtgtttcccttactgcttttatttactttcacatttaagatctaattttaaaatcattaaaataggccaagtgtaattaaggcatcct

SEQ ID NO: 59310 - DNA, 3604 bp, Homo sapiens
  misc_feature (3579)..(3579): n is a, c, g, or t
  misc_feature (3584)..(3584): n is a, c, g, or t
  misc_feature (3586)..(3586): n is a, c, g, or t
  misc_feature (3598)..(3598): n is a, c, g, or t
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctgtctgnccagnancaactcgaggcnggccct

SEQ ID NO: 59311 - DNA, 2377 bp, Homo sapiens
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatattctcaaataaaaacttaaggttataaagtgtgcataaacattttataaaataattttgtcatttaacatatttggaaatgagactttataccgcaattttacata

SEQ ID NO: 59312 - DNA, 565 bp, Homo sapiens
  misc_feature (36)..(36): n is a, c, g, or t
cctgcacggtgcgagctctagaggagtctcccgtcntgtgactacccagtgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctg

SEQ ID NO: 59313 - DNA, 1325 bp, Homo sapiens
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggaggctgaggtggacggatcgcttgaggtcgggagttcagaaccagcttggccaacatggtgaaacactgtctttcaatga

SEQ ID NO: 59314 - DNA, 927 bp, Homo sapiens
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaaagaaaacaacgcgtcgccccgctaggctctggcccatacgtccgacaacgtgtcgcgaaaaagagaacacaacca

SEQ ID NO: 59315 - DNA, 607 bp, Homo sapiens
gagaggataaagtagaattaaccaagagccaataggaaagggatcctaggagtatcctttaaacactagtggattaataagtcaccaagagttagggttgatatagaggaatgaaatcccagacagtagtgcttgttcctcagaggtaggtgttacaaacagagggttcagctctcctcttatttaagggtttgccgaggcatcacagtaaaattgacttctttttgagagaggtaaagctctgacttccagcttgaaatttagcctctgacttgtctggcttctctcattctctccaagtagatatctgccttagaacattaatgaaagccaaattccaaaacagcagtgcctaacattgctctgtgtgcaaacaagtctgcctgagcaggcatgaacatgaaatgtacctgaaggccagagagaacagtgcagaatgtgcaggagggctttgcaaatctgaggtggctctatggaaagacactaagtatgtcaagactaaaactagaggtgtgtgtgtttgaagagattatttctgcttactagtttctgcctgtcttatgcttgtttttaatttatctcattcatttatttaaattgcctttaa

SEQ ID NO: 59316 - DNA, 2234 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctagtaagtgatgaggggagcgggagccagtccgcacggaggcagtttgataccaggtagccctgcgcgtcctgggacctgccgtggagctgggcggacgatgctgaggcagatctccaagctgcgtagccagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaaataagtaagcgagaggtttgaaacaaatgaacgaaggctaaaccttctatcgaaaaatggcaacttggaagtctccttgcttcctgtattgtttatttattctaggccctaggctgaccggccagaataacaggtttgttgttgttgttatttttttttaatgcacacctactcctgttatttcagtgcccctctccagttcctgcacttaaaaagtgtagctgccttacaaggccctctactatttggctccataacttagaacctgcctttccaggttccaggcctatcaaacttttacttttttccaacgggtcattttctcctgtctttgaaacttcgtaaagatctttattacctgtgcctggaatttttttcttttcccttccttgctaatatttgtcttaaagccccaagctgagacatgatttatctctaggaagcttttcctgatgtcctaagtctgggtaagagtccccttttaggtactcttatagcatcctgcatgacccctgttacaataccttagtccgtattataattgctgttcattattttatgtctcctactagactgcacatctagtaaggagtatctgttttgtacattgttaatttcccaaagtctgacacaacatttgacacataataagctcccaataaatatttactgaatgtaaaaattctcccagctatatgtacaacctgtaaaattgactgttcatagtggagactttattttccctttggtcttttcagctacactggcttacagatgtgataagatattttctttaggttcctttctctgtcttgcctcttgttggggaattgtttactcacccacagtgatttgtctctggctcccgttttactaaccagagcaagttggactaggaggtgtttgcctagctcaaactggccagtcagatcctctccttggtttcagaattaggaccaagagagtcaagtctgagtcttcctatggagctggaactgtaacatgttaacttagcacctgtgaggattcatacatatctttttttgtgtacagagaagctgagaacagaggtctgcagagagacaatgaagcagagggaagttgaagtgtaggattgagagaaagcccttaactgcccttccttaaacatggctgtatttctgtaccaggctctgtgacatgtttgtttccttataaattctcctgttttggtcaaaccaacctgagttaatgtctgttggttgcaacagactatattgtaaccaataaatagtaacaaaataagtggatttcctgtaataggccctcagaaaagatgcggatcaagctgatcaatggtgtcatggctattaggattctcttaccccggaatggtaaattggcaaaaacaagcaaaggtgttgattaggctgtggtctcttgtctctcagaactcaggtcaagtatgaatgagagtgaggttttaaagtttagtttgctcaagagagaaaaatggggaaggggcaaacttcagcgtgtttctaaggcctgtgacctgattagatttttgatgttggctttagcaaa

SEQ ID NO: 59317 - DNA, 2102 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtttatggtttgttttagtatgtttttgtgtccatgatgagattaaattttttatctgcttcct

SEQ ID NO: 59318 - DNA, 2136 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatacaaaaaaacaaaaaaaaaaaaaaaacaacaacaaaaaagaacaaaaaaaacgacacaaagggggggggcgacacaaaaagaatccccgcgggggggcccaaagaataacgggcacaccgacaggtttggtggagaaaaagggggcccccaacaaggagcgggcgaatatataaacaaaaagacacgggggcgcaggaaacacaacggggcagcgggaaaaacg

SEQ ID NO: 59319 - DNA, 2086 bp, Homo sapiens
agtcatgggatctagagatgaagaaactgcattctcatgctgattcggttcctgtcggggtgtcttcaaactggttggtgtcagctttctgctggaattcagcgtctgaaaaacatcttaagcaatgcttaaacaaaagccttatgattctgatgtcagagatcctacccataggagcaatggggatgcaagtcatcagtatatagggctatgggatgactttccgtacaaagaagtgggccaaagtgcagcgtgattaatgctcaattatatttctgtctagaacctggcatgcaattcttgttaaccctgtaaggacagtgtcacttttagggctcttttaaaatttgtctgtaaaatgagggctacaaatacaaaataattcttaatcaatttatagattatttgcaaagccatgttttattctgatcttgccagtgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59320 - DNA, 1988 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59321 - DNA, 1639 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttatcttataagttagatcatcttaatgaaatgcctcgattttttcatttcttgatgacagtttt

SEQ ID NO: 59322 - DNA, 974 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagagatagtgacaaagtcagtttgatgt

SEQ ID NO: 59323 - DNA, 947 bp, Homo sapiens
ctactttggaggctgaagcaggagaattgtttgagtccatgaagtggaggctacagtgaactgagatcatgccattgtactccagcctgggcaacaagagcaaaactccatctaaaaaaaaaagaaggccctcaccagatgtggctgcttgacttgggaattcccaccctctagaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59324 - DNA, 2042 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59325 - DNA, 681 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctcctgaactcctacttcgaagcctaccgtgtaggacggacgagctgcctatgcgaactgcctgacctagaagaccaatactactaggaggcccaatgacctaagtaaacgtagatagatggtggatgctggtgatgccatggtcctgccactggcatgggccatgtttttggataagccagtgtaaggcgcctagcggtctgtacctatggtgaacccataggcccggttgtgaagcccttgtgtgcctggtgcaaccggaaatgggcctggacgggcccgagaaactacttcgcaagagggccctaggtctggtaaggctccagggaagcgcatgcccaggggggcttattgcctggttatggccta

SEQ ID NO: 59326 - DNA, 2097 bp, Homo sapiens
  misc_feature (2069)..(2069): n is a, c, g, or t
  misc_feature (2075)..(2075): n is a, c, g, or t
  misc_feature (2080)..(2080): n is a, c, g, or t
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtttctcggccgctcgtgccgaattcgatanaagctntcganccgcgacctgagggggg

SEQ ID NO: 59327 - DNA, 1722 bp, Homo sapiens
gtggagcgcacaaacctcatcccttgtgcctttgtttttcagagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59328 - DNA, 2362 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatcctagggggctttgaaacagtctgttcagcatgcctttggtgtattgaggagggagccgctgatggcctggggacactggggaaaggttcacagtggaggtgacatctgggggtaggtcgtgcttgctaaaccgtcgtctttggggacagggttactgctttaatacttcttttgatccggagggataggcatagtgctgattttacagtttcagtttagtaaatatataccatttgacagaacaatctgctgattttattattaaagttcagtattaatagtcagtggacagttttaatgactgtttgtcctgctgcaggtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59329 - DNA, 2154 bp, Homo sapiens
ggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatcctagggggctttgaaacagtctgttcagcatgcctttggtgtattgaggagggagccgctgatggcctggggacactggggaaaggttcacagtggaggtgacatctgggggtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 59330 - DNA, 579 bp, Homo sapiens
atgtacaagatgagcctggaacatcttgtgctagcaggcaaggaagcccaaagacgaatttgttaaaagaatacaggagtcaatgttaaaggttcccaggtggtcaagtatgaaaatatttgatcatcagtagaagaacaatttcggtggaatgaaaaatattgaatgttttaaaatgtactcatttatgagaaccagaaactgaaagtgtcccccagagttagtagtctctattggaggtacacaccacaccagttctttactgtgaaaattaacaattaaaggaaagtgttaagtatttattttgctttttctatacaaattgtgtttcaggacaaccaaatcatttaaagaaaattcttgaagaatgttggctaataaatatggaaggcataatagacttaaaatattactgtttttccaccccaataagataattgaatcaaacaacagaatcagaagataaagactaatgtaaattaatacagccactgtggagaacagtttagaggttactcaaaaaactaaaaatagagccactatatgatccagcaatcccattgctaggtatatacccta

SEQ ID NO: 59331 - DNA, 926 bp, Homo sapiens
ccgggataccgagcgcgtccgtagtggcggctggcgctagggaactgcagggtctagggtgttgttggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcaca

SEQ ID NO: 59332 - DNA, 1139 bp, Homo sapiens
ccgggataccgagcgcgtccgtagtggcggctggcgctagggaactgcagggtctagggtgttgttggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaaaaaaaaaaaaaaaaaaaaaaaaaaacaaaaaaagggggggggcggtaaaaagatatcccccgggggggcccaattaaggggtaccacggtttttttggtaccagcggggcgccataaagagaaccggattataggatagaacaggggccgggtatcaaaggttgtacgagaaacacggtaaccgggaacctggggaaggacctaaatcgggg

SEQ ID NO: 59333 - DNA, 1049 bp, Homo sapiens
ccgggataccgagcgcgtccgtagtggcggctggcgctagggaactgcagggtctagggtgttgttggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcaca

SEQ ID NO: 59334 - DNA, 1856 bp, Homo sapiens
  misc_feature (53)..(53): n is a, c, g, or t
  misc_feature (163)..(163): n is a, c, g, or t
gacttggagctaacgttggaatatattgtccagtgttctgatcacctgtaacntttttaaacaagattaatgaatcctccctttaaagacaagatgcagagtaaaaaggaacaaagctcttgggtcctgcggaagttctcatttgttcattccctaaaccatnattgggtgctgactctgcaccctgcactacctatggggaggcagagagagcagcccagggctggtggggtgggcagaggtggtggtgacaaccgcagggtccggggagctgtggtgctgcagagtaagcctggttaacagcaagaaagggccttctaggtgcaagggcaggaaagggcccaggtcctccaggctccagccccaagggagatggggtccctgaggtcttcccggcacttccccttgggaccactgccccccaagtgctggttatggtttgtccctgagccccacacctctcatctcgaattgcccacagtacagtttattgagcacctgctctgtgccaggcattggcgcaggtgccggggatgtagtcagtgaacaggtcacgccctgacccctggagttttgccctgtggagcagacagacatcagacaagcagattttaagacagtaggtcatgttcagtgccaagaggacagtaagccagggatagggaccaatgggggctggtcccagggccgccttctggcacagcacacacccctgctcgcctcagcctcctgagaagccccctggcctgtcatcaccacccagagtcttgtcccctcctcccaccctttccaaccggccatgatgccacctaggatgcaggccacagcaccaggagctggcgctcaagtgatccgccagcctccgcctcccttcctgtgccagtggagcctgcgttctgtgccctgccccacctgtcccagccgtcctcgtctccttgtcccttccacatcgtttcctctccttccttcaaactcacatcccctctgcccaccatgggctgagcctctggactccatggtccctctttttcctccttcctctgtcatccactgtcactccaaccctcctgtcctcgtggaagaccgcagctcccaagccatcccttctgtccgccttattcttgacaccatcctggctggtgtctgcagtcacatggacgacacagtactttgtccccagctctcctcctggtgcccacagcctctgcttctgcaccgccatccgggtcatgctgggccccttctcctgcccgatccgcgcacctcttctcttcttttgtgctctctgatgcggctactccgcctgacagagccacctgggacatgggtggttccatctcattccaaatccatgtcccaagcctccaaagaactgggaccctgtgcagcagccacttctcccaccactttcctgagatcacaagtcatcaaaaaagaaaaacctatgcatatagcacccatcttttcacctagaaataaagctacatttattatacgttttggtgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcaca

SEQ ID NO: 59335 - DNA, 1262 bp, Homo sapiens
ccgggataccgagcgcgtccgtagtggcggctggcgctagggaactgcagggtctagggtgttgttggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaaaaaaaaaaaaaaaaaaaaaaaaaaacaaaaaaagggggggggcggtaaaaagatatcccccgggggggcccaattaaggggtaccacggtttttttggtaccagcggggcgccataaagagaaccggattataggatagaacaggggccgggtatcaaaggttgtacgagaaacacggtaaccgggaacctggggaaggacctaaatcgggg

SEQ ID NO: 59336 - DNA, 993 bp, Homo sapiens
ggggggcgctggcgtgcaaaggcccggtagcgtgtgtagcaggtgtccagcggaggtctgtagaccgcacacgccagcccattcttcgcgcggcgaggcgcgcctggtgatttctagcgagcacgtggtgcgcttgctgcgcgagagcgagtgccgctttgcgcgacgaccgagtgttcgtgcgctcagtagatcgcagcattcctcgccggagctgcacggacagtacgctggaatgccaagttgcgatcacagggactgcgcatccgcgactcgcagccgggctggacggtgcgtagcgcgctggtacgcggcgggcgtaattttgtgcatggcgtctggtcgatggagcgaggatccagcttcgctgctaaatggacgagagatgtgaagatgccctacggccatagccagcaacaacagactccaggttctgcatctcaggggactcctgaagggttctggcactaagctagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcaca

SEQ ID NO: 59337 - DNA, 436 bp, Homo sapiens
tgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacacacctctgtagtgtgagtgtttctctaaatgggaatttagtgtgactgcttcgtggggcctgattcatgattgcttttcactg

SEQ ID NO: 59338 - DNA, 453 bp, Homo sapiens
ggccaggcttgtctcaaactcctgacctcaagtgatctgcccacctcggcccgccaaagtgctgggattttataggcatgagccaccacacctggccctgatattggtttttattacaaaaagaagacagacaattgtatcttcattatggattaaactctttattaagtatcttttttgtctcatttttttttttgccttgaattcagtggagtctgatatgaataatgctgtccttgcctgtatgtttgtttgaatgtgtctggcatgtattttattacaaatctcttagtttttattttttagggttacttttgtcaaatgtttttgttatgatcagctttagaaattgaactcttcccttatgccctggaacagtatagataacatataaattacattttccttagagaatgaaagagcttaaacagaaaaccatctgaggcccagtgc

SEQ ID NO: 59339 - DNA, 238 bp, Homo sapiens
atgcattaagaaaagacagccaaatgacagactgataaaatattttcattacaaaattggttgagaactaccgtgtgacgtaaatgaagtttctattacacatgtactaacagagacttttcattacatattctaggatatatttaaaatatatgtatattttgatattaagggaatatattttgttgtcattttacaatgtgtaactacatatatattacaaaaatggccaacccaa

SEQ ID NO: 59340 - DNA, 518 bp, Homo sapiens
cttttcctgtcatgaggggaacttacctgattttattgaattatttggtgccattgagttccttattgtttccctctgacctagatttctgggtgtgcgccagtaacacgactgtgattgttgctgctttataacattgtctgtggtcagtccaaacaagagtttaaaataattgaatgaaatggattttaaacaatggtccccccaccctcaccccgtggcactcggccaaaggaagaggaaaagttctctgttaaagaaaatgaatcagagaagaggcccagaccgtgcctccgaaaattctcattgtagggactaagtcctctcactctgaactcacacccgtctgttcgcagcctgacctcatatcctggtctggatgtgcggcctcaccggggtgtcgtgcgcacgtgtggttgtcctgtgggtgccagctctgacttcctccccagacacccactgcctcagccttaatcacaggacgcgcgttgagtagaaatgagaccagttagtattgg

SEQ ID NO: 59341 - DNA, 632 bp, Homo sapiens
agagcaggccggtttctccagagtccccataattagaatattggtttatcagtgtgagtgcaactcttcattgatcatctcctccgcaccaggcacaggcctggaaccttacattatttcatttcaaccttgacagtcctgcaaggtacatattgttatccccactttacagatgaaaaaatttgggttcagagaggttaaaaaaacttactcaaggccaggcgcatggtggctcacgcctgtaatcccagcagtttgggaggctgaggccaccacacccggccaaattcagaatgttctaaatccaaagtctagtctctctctactgcaccatgatgcctttaaaaagaatctaggggctgggcacagtggcttacgcttgtaacccagcactttgggaggagttcacttgagctcaggagttcgagaccagcctaggcaacatagtgagacccccgtctctactaaaaatgaaagcaaattagctgggtatggtggtccatgtctgtactgtggtctaagctactcgggaagttgaagcaggaggatcacttgagcccagaaggtcaaggctgtagtgagccatgattgtgccactgcattccagcctgggcaacacagtgagaccctgt

SEQ ID NO: 59342 - DNA, 460 bp, Homo sapiens
tttgctcatggccttttgctctgttttcaaagccagcagcatagcatcttcaaatctctctctgactttgaccctcccgctgactttgatcctcctccttcccactttcactgcgaggctgcttgtgattacattgagcccacccagaatgcccagggaaacttccctatctcaatatccttagcttaatcacatctgtaaagtcctctgtgccgtgtaaagtgacatagtcacacattctagggattacaatgtagacatccttgggaaggcattattctgcctatcatagaaaacatacattttgaactttgaaaacagatatcctggattttctcagaagctaactaccatatacatcaaagaagattttattttcttttattgccgataattaatcctcatttcagaaatcacattactgactgtagcatggctcactatgtttgagctgtccaaa

SEQ ID NO: 59343 - DNA, 621 bp, Homo sapiens
caagagaaaggaaccctcttgtctacttttaatcctctttgaattacttacaatatctgatgccttgtaatgccatgtaaatagttgttatactgtattgttttatttgtattatgtttattgttgcatttttattttttaaagatttgcagaatattttcgatctgcgattgtttgaatctgcagatgcagagggcttactgtgtatgtcttcttaacctcctcctagttgtctttcagctccatatttacttatttttaaaattacctacagtaaaatttactttttttgtggacacttctgagttttgacagaaagtagatttgtgtaaacagcatcacaaagtacagaacaggtctgtccctccccaaaaaatttttttgtggccccctttagggtcaaccctactctcttaccatcagcccctggcaaccaaccagtgactgcactttatcctatagttttgccttttccagtatgttatgtaaatggaactgagttgagcttctttcgcttgatacagtgtatttagatgcatccattttattgtgtgtatcaatagtgcattcctttttattgtggaataattaataaacattgattaaaagaccactatatga

SEQ ID NO: 59344 - DNA, 412 bp, Homo sapiens
gtccctttgcccttcctttgtcttctgccatgattgtgaggcttccctagccacgtggaactgagtctattaaacctctttcctttataacttacccagtcttgggtatgtctttattaacaacataagattggactaatacagtagaggaaatgtaagtgtgcttatttcctcatccttcttagtagcaagtcaataaatactctcctaagtcaaattgtcattaaaaataactatccaaatctcttgttggtttatttaatcttctttattaactttagagtgttctttcgggaattaatcatggtttaaaaaatatcaaacattcaacaactctaattttactttaatgtctttttttctaatatatctaataaaattgcattaaatttttaagttgaaattgcatgta

SEQ ID NO: 59345 - DNA, 716 bp, Homo sapiens
gctttcaagacctgatgctttgttttgaacaggttgatacatctaggagtgaaatacatcaccgctttccctgctcccgccgccattaaaattgtgtttggcatctgaccaccaagatacagatatttcctagactgttttgcagctaggtacttagaagtttttctaagttatttaaacttctcaccacacaaaatctggatttgtatctgtcacgtagtaattgcttgataaatcatttctctttcctctggagaaaaatatctgctttctttaaaataaatgttccatccatgcagctaagcagctaaggacacgaacagccactgatacaggccaactcatcagtagattattgagatttcatactaggacctttcattggctgaacaaagacaaagacagaaatcaaggaaggtcaaagaagcagtcagttttctggcacccaaagttgttggagaagggtacagagtcggtaaataagtcatatgacagacaggcagtattttcttattttaataacaagtttaaaaatcccacttcttgtacttaccttctgtctgacgtcatcagtattttaaaatgccaactgggatcaagttcaacactgcattactgaagaatccagattatctacatttcaagtgccaaatgaaagaaagaacccagaaaataaaacaatatgatgataacagtaaaattttttaaaatgaaat

SEQ ID NO: 59346 - DNA, 516 bp, Homo sapiens
ctcatttatatagatgtttctcagtttaatattagacatttaagttgtttatgattttcactatttaaaatcaggttaggctgtggcatgggtgaaagtggccactttggcggtgcctcgtcctcacagctaatgggaagcaagcgtgttctagaaagccagagtctccagcgacccctcttaccaccatcatggcagtcccaggttgcaacaaggacagtgtcagagcaggctgtaaaaaatatggcttcctggtcacctgacttttgaatgctgcaactttctccaagtagaccccaaagggacatagttttggatgtcagcagtgcaaacagtgaagattgatgaataaaatgaagaatgaataaattgcaagcattactggaaaaaaagaataaatgaagaggagaagaaaaagcaaagagaaaagcaatttttttaaaaaaggaaaaggtcttattcatccagttccactgaaaaggacatttcaaaagaaacaaaaatatcagaacaaag

SEQ ID NO: 59347 - DNA, 1822 bp, Homo sapiens
cggccgcaaacgtttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatatgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgta

SEQ ID NO: 59348 - DNA, 1794 bp, Homo sapiens
cacaccacctgagtcaatttagtcacacaggactaaaatctaaatgagcaagatgttgttattagttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatatgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgta

SEQ ID NO: 59349 - DNA, 1625 bp, Homo sapiens
caacttaaggctaggtacgaggctgggtgttgaatcccttactcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59350 - DNA, 2100 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59351 - DNA, 586 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaaggtaaagggcgccggcggagaagtttgctttcagaggagaggggagtgcggaatcgctccgccgcagaggactcggcgccccgggctctctctggtcggcccgggataccggacggagaacctggagaggccagctcagagacgagggaggctctgctgggaggcgccctttaccccggcccgagccgcaccaagcagccgagtttacaaacacggcacccgggccagggaaaggcagctgattcccgctgcctcgggtggggagatgtcgtgtgtctgtggcaggtgccctctgctttcggtctggggctgttcgctgtgtggccatggacaagtgacttgacctctctgggccttcggcttcctcc

SEQ ID NO: 59352 - DNA, 3467 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59353 - DNA, 3438 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59354 - DNA, 3182 bp, Homo sapiens
tcgtggtgctgctgctgtgaagatatcattcaggaatacaaaaatatagccttctaagttaaaagcaaggtcagacgcagctgctatgaaagccccgagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59355 - DNA, 2815 bp, Homo sapiens
agcactttgggaggctaaggcgggcagatcacctgaggtcaggagttcaagatcagcttggtcaacatggtaaaaccctgtctctactaaaaatacaaaaattagacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59356 - DNA, 3413 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcatctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacgtgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacaagttgtcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttatttatgtgacttttgtgttt

SEQ ID NO: 59357 - DNA, 788 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtaagtccaggtgcccccaccccctgtctttctcctgctcagctaactttggtgaatcccagagtgagtgcctaccttaggtttttgttgcctgttgtaaagagtccccttactcattttacccaggaagggagtcctttatctgttgaacacatatttttatcagggcactgtgtgctgggcacattggttaaaacaagcagagctggcagctgctttcacgaagctgagagtctatttgggaagagtaaaagctgttgatgccactagattaattgcctttctgggcccacctcatggttgggtgggaccacggaactcgttctggctgatgcgttatagaaagaagaaccagtgtcacttctagggcaagcatttagttgcca

SEQ ID NO: 59358 - DNA, 641 bp, Homo sapiens
acggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaaggtaagggtagagatgttccactggccaaggtggtggggggtgcttccttctggccccacctgcccagttcacctgggcactcccactgttccctccctgtctgtctgatccacaagcaattgactcaaatctacaggatccttggccctag

SEQ ID NO: 59359 - DNA, 561 bp, Homo sapiens
actcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagagaaaaa

SEQ ID NO: 59360 - DNA, 698 bp, Homo sapiens
actctcagtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagcaaaaaa

SEQ ID NO: 59361 - DNA, 1343 bp, Homo sapiens
actctcagtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59362 - DNA, 1235 bp, Homo sapiens
actctcagtatcctgccaagagtcctccctgaccaccagaagttccacctcaccatcaagaaaggccctggtccaggatgtgcaaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59363 - DNA, 1318 bp, Homo sapiens
tatcgttctgttgatttttccccattctgttttagagccttttgaaggtcttcatgctttctttgtataatttcaatgtcttttaagtatttcttttccaggatttgattttttattgtgtgtatttccagcctgagcctggcaatttcatcttgcatcaaatggtttttatgcaacaggtcttcttctttttcatgactatcagaaatctcaaactgcagagttcttgttcccatggcgatatagatatcgcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggtgcagagggcccggccaggttgcggggcagcggtctggggtgggacccggaactgagagcccagggttagaacaacaatctcaggattgagacaggatgtgggactgaggatcctggtggcagctgtaggcctcaccagctgcgtgacccaggccacgttccttcccttccttggcctcagtttcctcatcaataccaaaagacgatagaagtttgactcttgagtcccagctctgcctaggcccccgggtaccctgcactctactcctcactgctcttgggagccggacaagctctgaccgtccccaatcctacccctgagataggataaggatgggcccctctcacttctgccccttcttccctcccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59364 - DNA, 1064 bp, Homo sapiens
actctcagtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcacccttctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagagaaaaa

SEQ ID NO: 59365 - DNA, 914 bp, Homo sapiens
actctcagtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggccacttataatattctgcggacatgaggactggagacagacagggttgcctggtccctgga

SEQ ID NO: 59366 - DNA, 456 bp, Homo sapiens
  misc_feature (2)..(4): n is a, c, g, or t
cnnncggccagcatattttattataatgatgtttgtctgtgtgtctcaccattagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59367 - DNA, 1015 bp, Homo sapiens
tgcttctctaagccttgttctattttcaactcttttctccagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59368 - DNA, 1715 bp, Homo sapiens
actctcagtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggtgcagagggcccggccaggttgcggggcagcggtctggggtgggacccggaactgagagcccagggttagaacaacaatctcaggattgagacaggatgtgggactgaggatcctggtggcagctgtaggcctcaccagctgcgtgacccaggccacgttccttcccttccttggcctcagtttcctcatcaataccaaaagacgatagaagtttgactcttgagtcccagctctgcctaggcccccgggtaccctgcactctactcctcactgctcttgggagccggacaagctctgaccgtccccaatcctacccctgagataggataaggatgggcccctctcacttctgccccttcttccctcccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtgtgttcttgtcttaaccctagatagaa

SEQ ID NO: 59369 - DNA, 366 bp, Homo sapiens
gccgctcttccttcaccccttgtagctcctgggggcgcttggggccatgggtccacctgggaggaggtgggaggtccccagacttgaccccgccccggccccacccagactccccgccctgccccggaccccagcccagtcaggactcagcacgtcggagggccctctggcccgaggtaactgaagccagagccgctgccctcgctggctgccgggagctgcctcctcatcagctcgtcccgccccgccctcctcccacctgcctgctgcccgcctgctcccgcctgatccgccccggccccctgccttgccagcccgggtgggcatgctgcggggccggggcttgggctgtggcgcttggctttg

SEQ ID NO: 59370 - DNA, 724 bp, Homo sapiens
tttagattctgaagctgtgacttgctttttactagcaagatacatggatacatttgaagctgagaagcaccccatcaaagtggggtgtgagtagcctctttgatgactgtatacttcatgtattgggacattatttctttcatgtattttgccaatattacggtgtagtcacaaaggggccaagaattttccttctggtagtggtgggctgtctttgccacatctagaagggcaattgtttgctcaaacaaggtcccatgaatatctttgaatacttgaaataaaaccccttgaaaacacgtaaatggttctctgttgaggtcagacctagagtgcatatgactgcactccattttgtttgtttgtttgcttgttgaactttaaaagtcaccagaagcagccaggagcttatctttgccagataagctggggagtgtgaggtgttcgggcccagcacggaccgggcccagccgagcccccgcctttcctgcagccctgctcttcctgttgcagctgtgatttctgtcctgagggggcctttgatgtaaagcgcagttaatattggaacgtgtcatttgcatctgaagatagtggtgtcttttttgattaggagaaacatttcttctagttatagaaaaagcattattttttcccccattcagatataatgatcacgtgagaagtgccagggacacagaagcgccagaccaagagccatctgttc

SEQ ID NO: 59371 - DNA, 466 bp, Homo sapiens
acttcttcatcttctttagctgagatacaaagtaccagaagtgggacttggcaacgacatgatcaggtgcaaagattcgcatgtggtagaggggtggtgtgtggcatttgggagtgagcaggcagcaacccaccaccttgtactcttgtagtgtgcccgaggccttcatggcatcctctccatgcttgccgccaccggcaaaaggagcctggctaatttttgtatttttagtagagatggggttttgccacgttggttggttggtcttgaactcttgacctcaagtgattatcctgcctggcctcccaaagtgctgggattacaggcgtgagccaccacacctggtcttattcttatttttcagacagagtcttcctctttcgcccaggctggagtgcagtgagctgagatcatgccactgtactgcagcctgagtgacagagtgagaccctgtctcagttaaaaa

SEQ ID NO: 59372 - DNA, 680 bp, Homo sapiens
acttcttcatcttctttagctgagatacaaagtaccagaagtgggacttggcaacgacatgatcaggtgcaaagattcgcatgtggtagaggggtggtgtgtggcatttgggagtgagcaggcagcaacccaccaccttgtactcttgtagtgtgcccgaggccttcatggcatcctctccatgcttgccgccaccggcaaaaggagcctggctaatttttgtatttttagtagagatggggttttgccacgttggttggttggtcttgaactcttgacctcaagtgattatcctgcctggcctcccaaagtgctgggattacaggcgtgagccaccacacctggtcttattcttatttttcagacagagtcttcctctttcgcccaggctggagtgcagtggcacgatcttggctcactgcagcttctgcctcctgggttcaagtgattctcctgcctccgcctcctgagtagctggggactgcaggagtgtgcccccagcctggctaatttttgtttttttgtttttttagtagagatagggtctctcccatgttggccaggctgctctcgaactcctggcctcaggtgatctgcctgcttcgacctcccgaagtgctgtgattacaggcgttagccaccacgtacagccataacttttactgaaaaaaaaaaaaaaa

SEQ ID NO: 59373 - DNA, 310 bp, Homo sapiens
tcagcattgttttctgtatgtgttgagatgattatttggtttttcttttttattgtgttaatttggtgaattgcatcaactttagtatcttaaaccaaccttgcctctctagggtaaaccttatgtggtcataatatataatcctttaaatacattattggatttctttttttaatatattgctgaggattttttatgactataatcataagagatattggcatatgattttctatacttgtaatgtctttgttagaaggagtttatattaggattatgctggcctcataaaatgggttgagaaatgttc

SEQ ID NO: 59374 - DNA, 465 bp, Homo sapiens
ccaagattccagagatgtggctggtttcacttccaggaagcttgctggaagactgccctgtgccccacgcctcagtagggcagggggcctcccctggttttaggatcatgcttctcctgcctgctgatgctacgatcagtgaccatggactcataaggcttttgtttaagaattgcctaagatgttcttcagatcctgaattccagcaggaaagctaatgccaaccagtttgaaaacaaccacagaggaatcgaatcagcacgagaatgcagtttcttcatttccctgtcccatgactttactctgcactctttgaccaatcaataatcctggaccttggcccacttcaaaccccttgaaatctctagctccaactccctggaggggtggatttgaggtttcctcctgtttccttgtttggctgccgtatgattattaaactctttctttgctgcaaaaaaaaaa

SEQ ID NO: 59375 - DNA, 446 bp, Homo sapiens
gcccaggctttcatgggaaggacacaggatcaaccaggacaagggaaagaagagccagggggcctgaactccagttccagctgggaagagacctcactgggtgaccttggctacgatcagtgaccatggactcataaggcttttgtttaagaattgcctaagatgttcttcagatcctgaattccagcaggaaagctaatgccaaccagtttgaaaacaaccacagaggaatcgaatcagcacgagaatgcagtttcttcatttccctgtcccatgactttactctgcactctttgaccaatcaataatcctggaccttggcccacttcaaaccccttgaaatctctagctccaactccctggaggggtggatttgaggtttcctcctgtttccttgtttggctgccgtatgattattaaactctttctttgctgcaaaaaaaaaa

SEQ ID NO: 59376 - DNA, 526 bp, Homo sapiens
agagttgaagatgacctagatcatgcgtcaacaaactatggcctgagggccaaagccagcgcaccacccgtttttgtacagcccatgggttaagaagagttttcaaaattttaaacagcagtctccccttatccatggtttcaccttctgtggtttcagttacttgcagtcaaccatggcccaaaaatagctacgatcagtgaccatggactcataaggcttttgtttaagaattgcctaagatgttcttcagatcctgaattccagcaggaaagctaatgccaaccagtttgaaaacaaccacagaggaatcgaatcagcacgagaatgcagtttcttcatttccctgtcccatgactttactctgcactctttgaccaatcaataatcctggaccttggcccacttcaaaccccttgaaatctctagctccaactccctggaggggtggatttgaggtttcctcctgtttccttgtttggctgccgtatgattattaaactctttctttgctgcaaaaaaaaaa

SEQ ID NO: 59377 - DNA, 385 bp, Homo sapiens
ccccctgtaccacccagagtcagccaaagctggagatctgtcagtttagaaaataaataagagtgagattaggggttgcattttttcccctttttgcaattaattcctgtgactggctgctctggcaacaatgtaaatacttgtagctttcagaacatgccaggtagcccatctcttctggtgggctggtacttatctgcaagggtagccttgtacttaatatgggcctttgttgtccctttctgtggccacagaacttcctaggaaatgacagtggggaaaatgagagctatggctctgggtagtccgctgatctcatggggatggggctggagccaggagaaaatgagatcatgagatgagctcaggaaagcactagcgaaaa

SEQ ID NO: 59378 - DNA, 530 bp, Homo sapiens
gacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaa

SEQ ID NO: 59379 - DNA, 391 bp, Homo sapiens
  misc_feature (106)..(106): n is a, c, g, or t
gactcacacctgagtatctaaagacacctcacgcaccacctatcctgagtagccgtccctgtggcctcttggcgccctgccggtgtacgttgaattccagggtgtngagctgtttgctgtctttacagatgaaaacacttcgaccaagttgagtttctgctccgaaatcatagtggatggtggcagagcagtggcctaggccatggtgctgacatcacagccattcttgcaaggagatggtaggatagccactcactgttcaggcttgagctttagccagcaggcaggatgtccagcttgtccaagttgattaggagcacccggcccagctggaacctgcctcatttttgcggttcccctttaggaaggcacccacagcttgcccagggag

SEQ ID NO: 59380 - DNA, 3566 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaaca

SEQ ID NO: 59381 - DNA, 407 bp, Homo sapiens
acttaaggacccggcagctatccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaaccggatagctgccgggatcctctagg

SEQ ID NO: 59382 - DNA, 972 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttggggtgagtgtgaggggcgggaaatctgtggactggggacagctccaaaacccgggagtaggctgaatagctggggcccccgactccgatctgggctctaggagcgtctttggtgctgttggcccgggcctcgcttcccccccactcccggccttccgggctttctcgccagcaaggccagaagggagcggtccacctgcagcccagtgttctcaggcgcctgagccccggaggtcaagcttactgggttccccctctatagtgagctggagtacagacggcaggaatctcagtcccaggtttctgctttggaggacaaaaccccaaacggacctgagcagacgtcctgttagcgggtggtgcctggaagagcctggggtgaggaatgcagtgagaagggtgttgcagttcttcaggagagaggtaacggggttctaagctgagcaggtggcagtgagtgtggaagagtgacgggcgatgtggctgtttgtatttggtagatttgtttgaacctgaaacttacagccttatgtgtgattaagaagatggtgccagtgacaggaggaggtattttatggagtttgagttttatcgaatttgaaacagtggtttacatggagattgtagaaagactttaaaaaaaattatgagaattaagcccgaaagactttcaaggtgagacccaaaacagatgaagtttcatataaaagggtaaga

SEQ ID NO: 59383 - DNA, 3692 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaaca

SEQ ID NO: 59384 - DNA, 4161 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggtaaggataaggttgacttgtagttaagggtaattgagttttgcaagctcatttattaggcatttagaagagtaacaaaagtttccttctctagaaagagcagtagcccatttgccttttatactgtgcttggtggggcagtctcacaggcaccgaccaaatgatttttcagagcaccttatttcaaacagcttcccctcacctccgccctcatttaagcaccaaaaagagagttattcatattcacagaaagtagaattatacttcacagacattccctgcctgtgtgggaatcttaaccaaaaccataccatcaaagtgcaataatttgtaaatgatagaagagacatttcttccaaatggtggaagggacactggttaatgtcagatttaccatatagcgctcattgctaacattatattggttgggatgatgataatttattctttttcattctttttgatacaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaaca

SEQ ID NO: 59385 - DNA, 5200 bp, Homo sapiens
  misc_feature (4460)..(4460): n is a, c, g, or t
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaacattctccaatgggcaaggctcattgtcaaagcagggtgaacatgatcagattttcttctgcatcatcacacaagctgcgagtgttgctgcaaagcacttctcagtactccttccctaacctcagtatgttaatagccattaatacttggcttaagcatcaccattctggccacagtctgagagattagtgatcaaagctcccttccctatcactaccaccacctactgataacaaagatttctgaatacttagtagtagtaaaatatttttcaagcacagagttacagctaatcctggatcacttgttctaaattcataagggagtatatcaagagcaaatgaagtaaatgattctttcctgcgtgtgggagtcaccatcattttattcaaagggagttcctgtgataggttcattccttaagtggtgctacagaaggaccctaggaaaatgctgatcttgtcctgagaggcaactgatttgagaaaatgattatactacagcaggaaggcagcaccagtgaacatatggtaaatggcaaaaacaagacagttttagaaactgctaattcagtagcagccttggcctttcccttaactcaagcaggctggaatctgtctttatagtcggcaactttccaagataaagcagtgataatagcagttggcaacactaaatatcaatatcatcaccctttaatgacatgttacccctttcagatctagaaaatcaggnaaaaagtgatgtcccaactctactctaaaaacctgctcctactattttagtcagtgtttctttaaggaagaagaggactatgtccccaaaagctaactctgttttatagccctggtggatccctgaaaaccctatttattctatactgggctttggaatatgaaaaatggacctgtgtggccgggcgtggtggatcacacctgtaatcccagcactttgggaggtcaaggtgggcggatcacttgaggtcaggagttcgagaccagcctggccaacatggtgaaactccatctctactaaaaatacaaaaattagccaggcatggtggcacacacctgtaatcccagctacatgggaggctgaggcaggagaattgcttgaacccgggaggcagaggttgcagtgagctgagattgcaccactgcactgcagcctgggcaacagagcaagtctctgtcttgcagcagggggaaggacctgtggtactcctacaaacttaacaactttagcttttcggggaacagtggtggtctccacagatagctagaatcttctaagatgaaaataaactgtttcatccagctgctttctgcctgttaacctttgccacttccattccttcaagtgtgtaatccccagggttgtcttgtattacacacatccttgttaagtaaatataccactgttgatttcttcttccagtgcaacatttggattaaataaaaatctttagtttccag

SEQ ID NO: 59386 - DNA, 3639 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgcgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaaca

SEQ ID NO: 59387 - DNA, 1972 bp, Homo sapiens
atcaatgtaggattcttaaggagctttaagctaaggaaacctacattgataacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaaca

SEQ ID NO: 59388 - DNA, 3751 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaaccggatagctgccgggatcctctagg

SEQ ID NO: 59389 - DNA, 2593 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccaagagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggagtaaatggcagggtgcgagctcgat

SEQ ID NO: 59390 - DNA, 686 bp, Homo sapiens
agtgacagttcacatgccaaaagttgtgctgaacatgaacctgacacccacacaaggcagctatacatttgatccagtcaccaaggtacagccacttcaaatcaagagtgagcaagtgtttctgcaatctattttgtgatttgtggggaggaatggagggaaaggtttggcaccttgtttaaaactaaagttcgtatcaaaacctagagagcatactgtgctgtgcttctgccactggctgcagaaggaatcctgcagctgctactgagtagatgaacagaaaaatgtgtcattctgtcctttttcagagtgtgccttcactcatccattattaatccagagcctgactctgctatctaataagaaagaagtaaaagcttttttaaaaagagaaaacattatgtagattgaagaagatattatgatggtctatgaattactaagttttctatataaattgatcactaagacctttttcttcctttataatttaaaagcattatttcatactctttcacagggctaggaaagttgcttcctcactctacttaaatttttgtgtaacagagggttttcagagaaactgtagcagatgattttctctcagcttcctgattagctggtaaatatgattgttttcaatagcagagtcattgagctacctgataaatgaaaagacatgtttt

SEQ ID NO: 59391 - DNA, 1431 bp, Homo sapiens
agaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaagtatgttgatgcatcagccagaatctgccatcatacatatcaagtacaactcacctttccctgtttctttctgaaagttgagtacttgaggtcatcactgctcactttaaccatagctcaccaggagacccagtgagaacgggtgaaaatacgcacctaaaataatccgtatactttgaatgtatgagtgtagagtggtactaagtgagactagagtaaaatctatagccaagaacaagca

SEQ ID NO: 59392 - DNA, 858 bp, Homo sapiens
cgatgagctcagaagaaacaagctgcaaccatggttgggactgtccatatcaagaaccatctgcagtgagcgccatgcgtggagagccacatccacatgaaacttcatcctggccaagcagcaccacactctgtccatcattgtcactgcccgcagaagcactagcaagacagccacggtgcacacggagcaccttcacgactctcagctcccccaaggagtccagactaagtgactgtcaccagagaaggatcatcaggagcagccagggatgcccccggcacacagggactaggtctagtgagaacattagagggcggtgtaaatggatccccatgcctgggcacctgtaatcccaactacttgggaggcaccatcccagagagctccaagcgtcctttttttttttttttttcctttgagtgctgtctctggacatcttcagcccagaatcttctcaggagcaaaggcttcctgatgcctcattcatgtcaagaaaggaggccaggagccatcctgtgttcagatggttgagacagtgactacgatggcaggacaatgccgtgagaagcacttcatggtgacagagcccaacccagccgggaacagctgcgatggggaagctctggagcattttgtgagcaccgtctcggtggatgggaaagccaaagtctctgcccgtctcttactggaggcactaaaccccctccctgggttgacctcacagacattgaagtgagtctgcccacaaaggaaaagaggccagagactgtcgtgaagacatccactaggtaccagaaggaaagctgagggggcagcaaagacaataaaaggtgtctagagaggtcaaaaaagtgt

SEQ ID NO: 59393 - DNA, 631 bp, Homo sapiens
aattgatcctgcatattttttactgaaataaaattagcttcaccctatgtaatactatccaagaaaccatggggttttaatgggcttcattgttttatgggctttttcctaatacatattaaaatagatgactattaatgttcatctgtgcaacatttaaaatcatcctgcacaccagtagcgcagtatatcaacacattcagaaacacagatcaaaaagagtcaagaaaaacagatcactggcgttgggaatggacaaaagccaatgatcttctgtttctatgtgaacactcctgaatctctgtgcatttccaaatgggtaagatatatattgctatctctattcaaatgatttttaggattgttggaaaaaatacaccccagtacaaagcacaatcccaaggatctagtagtttgatacttcttgccacctgccatggtttgaatgtctgtcccctccaaaactcatgttgaaatttagttgccattgtaacagtattaacagatgggatctcagagagctgattaggccattaggactccaccctcatgggtggggttggtgccattataaaagggcaagttcagccctctttctttgcccttctgtacttctgccatgggatagcac

SEQ ID NO: 59394 - DNA, 368 bp, Homo sapiens
agggctgcactgctccatcttttatgcctccctctaccatctactgtggaaattaaggcctttccactttactgtggaccaagcatattcaggcttctattagcagtgagtttgccccaacccctgggaccttggccagggtatttaattctgtgttccaaaaaagtgcccccaagttaatgtatttttgctttgtattctgcagctttatattctgacctccttgatcaatcaccctcaaaatataatgccaggggtactatacagacttaatatatccctgctaattctttcagtttctttgatgagcattctttcttctcttgtcagacccagcatgtccctggccaggatatgctgagatttaa

SEQ ID NO: 59395 - DNA, 392 bp, Homo sapiens
atttcagtggaatgaaagaatagtttcctttttaggaaaattacgtgttccaaattgatatatccctgtcaccacctctcaacctcttcttagaaattcaatataataacagtccaggagcctcttgagcctttcaacatcctcagcccgctttttccatcctgcctttctttctgcccttcttggataatctttcccactcatttttcccctccaacaatctggcagtagtaggaaaggtaggaagaagaatggtgatttgttcaaattcttctttgccccacacatgaaatgggtactgctgaaggcagtgaaaaatagatggctgtgggtggtttgttagtgactcatcagtctttccattctgctgggaaagggaagggctgggacca

SEQ ID NO: 59396 - DNA, 861 bp, Homo sapiens
ctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaatt

SEQ ID NO: 59397 - DNA, 1958 bp, Homo sapiens
  misc_feature (2)..(4): n is a, c, g, or t
  misc_feature (6)..(6): n is a, c, g, or t
  misc_feature (11)..(11): n is a, c, g, or t
cnnncncgcgnggtcttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59398 - DNA, 301 bp, Homo sapiens
ctggtcgatctctagcaggatcccccggagacacttacgatagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59399 - DNA, 1833 bp, Homo sapiens
  misc_feature (2)..(4): n is a, c, g, or t
  misc_feature (6)..(6): n is a, c, g, or t
  misc_feature (11)..(11): n is a, c, g, or t
cnnncncgcgnggtcttcccttcccgcgttccccgggagaaacatggccgggagcagcgaggaggcgccagactacgggcgaggcgtcgtgaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59400 - DNA, 1968 bp, Homo sapiens
cataagttgagggaattctcctctcaagtgatactcttttgttatgttttaaacaaatttctgatgaaaaaataccataaccaaaataatttgatttgcagattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59401 - DNA, 766 bp, Homo sapiens
  misc_feature (2)..(4): n is a, c, g, or t
  misc_feature (6)..(6): n is a, c, g, or t
  misc_feature (11)..(11): n is a, c, g, or t
cnnncncgcgnggtcttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggctgcgtgctcggttgaagaggacaaccatctgtgatagaggaggactggccttcagtcaagggtatatgagtagctgtgctcccctgcaagaatctccaaataccctctggagaggttacctccaagtgctcattccctgtttccacatccggtttcagttaccaagatcagagcagaattaggtctgagatccagtgaggtgtacagtagcacctggaccattctagggctcactgtcttcaagccctggctgtgcccacagtcttcatgaagaaactggacactgtgtctgctggatgatgtatttcttcttgcttgaggttatgaaaaatatcaaaatatgtaaagaaacatgctggataaaaatattgccttgaaatcca

SEQ ID NO: 59402 - DNA, 1881 bp, Homo sapiens
  misc_feature (2)..(4): n is a, c, g, or t
  misc_feature (6)..(6): n is a, c, g, or t
  misc_feature (11)..(11): n is a, c, g, or t
cnnncncgcgnggtcttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59403 - DNA, 1905 bp, Homo sapiens
agcggaaggtggagaaaggtggaggaagatggagggagattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttaaaaaatc

SEQ ID NO: 59404 - DNA, 443 bp, Homo sapiens
aagagcaccgtgcccacgtggggaccctggagccctggagagcccatgtcctctgaaagccggcagctccttccctcccaaactcctttccctccacccttcttgaagcgtcctctgggttcctgcctccagtgtctcttctccccttctctcttgaactcactttcagggttttggctcttcttgaggagccatcaaaccaaggttatcagcagcccccaggatgctcaatgcagtggttggtttccagtcccatctcccttggcccatctgcggcagtggacgctgttaatccttctcttccttgaaatactctccacctggacaccgccctctcccagtctctgcacattaccagctgctcccccgcatcccgcctccatccctgggctctgtcccccgcatcccgcctccatccctgggctctgtcccctcgctccgtc

SEQ ID NO: 59405 - DNA, 152 bp, Homo sapiens
aatctgcacagtcactctggaggataggggtgacctcatctctactgtccagaggtaaactgaggacttggggttaaggaacgacctggttacttggtgtgtagcagcagagctgggatttgaccagaacatcagctctggatcagcaaatg

SEQ ID NO: 59406 - DNA, 324 bp, Homo sapiens
tccacactggtgccttgcatggacttttggtctgattctaaattgcaggccaccccctcagtagcatcttctcagtttaggacaggtcagtcaactggaagagaagaaaggagaaagaatgggaggaaaggctgagttgtaaggcccagttgctttctccatgggttaatggtcactgggctgcttaggtaacagggctccccatcccactgtgcaggggccacactgcacatccctctcccttgctctcctctctgtcacacacaagccagttgtttattgtctccatttagctgttttcaagcggcacaaaataaaggccct

SEQ ID NO: 59407 - DNA, 370 bp, Homo sapiens
  misc_feature (81)..(81): n is a, c, g, or t
cctttttctggagaacggggtctcgctatattgcccaggcaggtctcgaactcctgggctcaagctatcctcccgcctctnagcctccgtttccagaaggtcaccaagtaatatctgcgtttcatcagttgcagttaagatttttgtttcttgaaatactggttttcaaacagatcagaattacctggggagcttgtttaaaatataaatgccccaaggccagctccaggacattctgactccataggtatgtggtaagcccagggaatccaggtaagctcaggtaagcccagggtaagccagggaattgttaacaggaagctggtggtttctggcacctggacaccgactgaattctaggtagcttgcc

SEQ ID NO: 59408 - DNA, 284 bp, Homo sapiens
aaaagaaaagtgttttgagatggtagaaaaccctaagattagaaggcaaggcaagaaagcataaaacaggaatagttaactatgtcaaattgctgctgagaggagaaaagcatgagaactgaaatgtatctattagatttggcatcatggaggatgtgggtgagaaaatgaacaaaatcaggctcaatgaaatgagacagaagccatattaaaatggatgaatagttagtgggggtaagagaaaagatggaaaaggtaatgctgacaactctcttgcaaaaaaa

SEQ ID NO: 59409 - DNA, 272 bp, Homo sapiens
agtggaagtggaatctttaccttattagaaataagatggcaagcagtgtacttgaatagaacgtgagataaaggtggtcaatgacatggtacttagttaaaacctgctgttggaggaaaagccaattctcaaacactttgaaatatggagtttgttcctggagtttgtttaatcccctttgatttaaataatattttatggtactgaaattgtttcaaagggaaacattttacatttcaattaaagtcactgtaaaatcttcttgaagaaaa

SEQ ID NO: 59410 - DNA, 280 bp, Homo sapiens
gacatgacagctgaaccagtgaagaatggcattttagccaagagtcagccaaatatggatcaagagtgtgatgtggttctaaactccagtatccagaacaagacagcacttttcaactgcttgccctggagtgtcatggcagtactcactgttatagtatgtgaggaaagctgaagaaatcggaggtgtttagattggaggatgcaaatagcaggattttagaaactgcagagcacaataatgctatacgagtcaagaatgagctggttcttattgtgag

SEQ ID NO: 59411 - DNA, 342 bp, Homo sapiens
gccgtgcttcggcactgttccatgattggtgcatatctacgccgctgattggctgttaaagtggcctaatgattggatggatgcaaagaggaatggacgaatcagagtttagcactaagcggcccttctgattggataaaatggagctatgtttggatccttcccttggttccaaagctctgcaatagaaagtcaatgcaaatgaattgcattggtctctatcagaatgagcaggagtctaaactcacaggcatcaagcgaatgctatgcacccagagaggctactttaacaaaatttttgtaaatattttccgatgtaaaataaaatgtgttccctggatt

SEQ ID NO: 59412 - DNA, 565 bp, Homo sapiens
aggcagaggttgcagtgagctgagatcacaccactgcactccagcctgggtgacagagcaagattccattaaaaaaaaaaaagaaagaaagaaagaatggaaagagacttagtctgacagttatttatttcattattctttttctttatatagaatatgcttcctaacgagatgtaaatagtagattaatctgactcttaaaacattttgtcataattcaccttttgatttacattaatctgcaagcttgcttctatagaaaattgcaaccacacattttgccatttcttagacaaactagtgtactggcttcacactttttcactctttttccttttcttcctatatgagaatgttcaggcagcagtgccacactcggcttgcacagctctgagaagggaagaagatgctagcctttcagaacggtggttttgtcatgtgtgtcttcatttgttcattgagcagaacatttgttgaatgcctaccaaacatcacataccctgcactggggatggacaattcatgagtgaagtgttttggaataaccaataagtaagtcagccac

SEQ ID NO: 59413 - DNA, 377 bp, Homo sapiens
ggattgaggtgaagatacaacaaagaaaggaaattgaacggaattattaagagggtcaagtttgataggcagataagactaggtatcagcaagacatttcaaacaaaaggaacattatgtaattttttaaaaaaatacatgaaaataatatttaaacaaggaaggaatatgataaaagaaggatagttagtaaaatttggataacataaagattattgaatctccagtcgtcaaatttatcctaaactactggggagaggtctcatgtcagattttgattatcgagaaagaggggtcaagagtataagagaaattgctttttgttttgaacttcagtgtccactattgtggacaatatcaaattcaaacaaatatac

SEQ ID NO: 59414 - DNA, 185 bp, Homo sapiens
attggtgtgtaatcatccctctaacatataattatatactatgagtagagaatttggcagaaacaagaaaaggacatgggataactttcagatttaaagaggcaggctctggaacacaaactggtattctgctgacacactgctggcatatcataagagctactccacaagaccatttagaagtc

SEQ ID NO: 59415 - DNA, 332 bp, Homo sapiens
cacattctcagaggcaggctgtgtgctcaaccccaggggcctcatacacacacaatttgttcagcttcacagacctgcacctctcccaccaagcccgcccctatagaagctcatacttccatgcacagtcaatgtgctgagtgccacagcagtgtacacacacacacacacgcttacctgctgaaacatgcatactggttcacactcacagaagaatacatatgtacacacatatgcatagacatgcaagttcatgtgcttagacctgtacagaggtatacacatacacacacacacacacacacacacacacacacacacacacgcttggg

SEQ ID NO: 59416 - DNA, 482 bp, Homo sapiens
gcagctacattgcacattttcatatgaggaaactgaggcattgaaagattcagttattattcatatggctagtgagcaggaatgctaagtttagccccatagttgtttaactgaagctcattgtcttgtcttttttttttttttgagacggagtctcgcctaggctagagtgcggcggtacgatcttggctcactgcaccctctgtctcccaggttcaagcgattctcctgcctcagcctccctagtagctaggattacaggcacacgccaccacgcccagctaatttttgtatttttggtagagacagggtttcaccatgttggccaggctggtctcaaactcctgacctcaggtgatctgcctgcctcggcaacccagagtgctgggattcaggtgtgagccacagcgcccggccgtctctctcttaagacttaatttttttagagcagttttaagttcaaagcaaaattgataaagaaa

SEQ ID NO: 59417 - DNA, 1369 bp, Homo sapiens
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacctatgttagatactaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgaccagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaaaaaaaaat

SEQ ID NO: 59418 - DNA, 1109 bp, Homo sapiens
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgaccagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaaaaaaaaat

SEQ ID NO: 59419 - DNA, 743 bp, Homo sapiens
gtccatcctggggagtgggtgggcaccatgcctgacagagccaatacttgcctcctaggccctttcagcctgggcttgggagaccatcctggtatttgtcctcaggccagggggatctgtcttttccatctcagcattcttcgtcaaaagtccaggcccgggggttggggtagggcagtccccagagcctgtgctgatgagcctgtaggactggtggcagggacaaagcctgaggtcactcccctttccttcgtgagcttcgggctccccgagtggtcactgctgctcgttggcagatgaaagtggaactgagccccttgaagactccctctggagagggtggaggatgggccacgcaccagcctgcgctgtgcccacgggcccactccctcccctccttctccgcagctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggtaagggatgagggaggcagcagtgaggttagccttctcctgcgtggggcaagagaatcttggaggagtgtcttggtccagctacggggaggatgactgggagctaggactccactgtcctcggcctcttcagc

SEQ ID NO: 59420 - DNA, 843 bp, Homo sapiens
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggccgcctaccaggctggtacctcattctatgaccaacggctaaccagctgccccagatcttccttgcaccttccccttcataacccagagagaggcacatccggaaaagcattccattagaggcatcatctagaatgcaagatgagtgattcccagccatagctccatgagccgaaacacatagaatacgatgtgatatatccatgaccacaatgaataatcggcgtattaagactaacaat

SEQ ID NO: 59421 - DNA, 3986 bp, Homo sapiens
  misc_feature (1191)..(1191): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59422 - DNA, 2673 bp, Homo sapiens
agtagggggtggggaggaagaagggggtgtgtgcatgcatgtgaagaggggttgcatgtctgccaccacctgccccctggtacctgcagcctcagggtcagatggactcaggaccccccagcaccacattcatccactccctgaattttctctctcagggggagccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59423 - DNA, 1897 bp, Homo sapiens
cactaagcgatcaactgcagtgactgcagtcggttctcagacttcttaattttaatgccctcatgttaaaggaaaatgaaattctagtttagtgaaggtttgcaggagttttctggccacttggtgatttcttataggtcgacagagaataaatactttatagcttcatctatctaggcatcatttaaatttaggactggtttcctgggcatcgaattaaacaaagataatgtagcaatacttccatagataactcttttcaggcagttttgtcagtttatgtattacgtaaatgtcattaacttcacttgattgcatctgattgtattttggaaaatcctggacatgaacatgtatttaagtcattattgcaaattacaataaaatcgtgcatgcattagtagagtactacttgttgcacaacagaagtcattggaagcgttgctgagcaacctcagtgagaacgagctacattaccaataaacatttctggatcttatttacttgtttatcaagtagaactaatttcttgcaggacagaaattaggagctcattgtagccttcagttgatcccacaaaatccccgttaagtgttaagtgcccttgctaagggtagattcttaaacttaacacctagttgatatttgctattatctaaattattaaagtcaagatttgcttaatggttaagtttttttgttttaatccagctatgttagatactaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgaccagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaaaaaaaaat

SEQ ID NO: 59424 - DNA, 3968 bp, Homo sapiens
  misc_feature (1191)..(1191): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59425 - DNA, 3462 bp, Homo sapiens
  misc_feature (1191)..(1191): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59426 - DNA, 1819 bp, Homo sapiens
actaagggatcactgcgaatttatccttagtctgcaaatgctttttctagattaatgatttttcactcattagggtactagacacatcagcctaaagtggcatcatttaaatttaggactggtttcctgggcatcgaattaaacaaagataatgtagcaatacttccatagataactcttttcaggcagttttgtcagtttatgtattacgtaaatgtcattaacttcacttgattgcatctgattgtattttggaaaatcctggacatgaacatgtatttaagtcattattgcaaattacaataaaatcgtgcatgcattagtagagtactacttgttgcacaacagaagtcattggaagcgttgctgagcaacctcagtgagaacgagctacattaccaataaacatttctggatcttatttacttgtttatcaagtagaactaatttcttgcaggacagaaattaggagctcattgtagccttcagttgatcccacaaaatccccgttaagtgttaagtgcccttgctaagggtagattcttaaacttaacacctagttgatatttgctattatctaaattattaaagtcaagatttgcttaatggttaagtttttttgttttaatccagctatgttagatactaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgaccagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaaaaaaaaat

SEQ ID NO: 59427 - DNA, 2690 bp, Homo sapiens
  misc_feature (1191)..(1191): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatgctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59428 - DNA, 703 bp, Homo sapiens
gtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaaggtgaggtctctttcctgtgtgtcttagaagccatgagcacgcttaggtaactagagccctgccacagcctgagcagcacagcacacatctgcaggctttcctgccagacctttacctaaaggtaatttttctcattaggagagactccaggtcaagagtgatgacagtaaggttgcatttaaagctgcattacattaaatagtggactggtctagtgattattttcccacactgggcaatatttgcttaatgattaagtttttttgtttttgtttttgttttttttaatccagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaatgtaagtttctctgccattcttagccaatatataaaaattacattagcctaattgctaacaatgcca

SEQ ID NO: 59429 - DNA, 360 bp, Homo sapiens
gggcaggggagcccagtctaggagaccccccaacctagacacatgtagcaaacaaaaacccagatgtaagggggtaagtgggtctggggccttccactgggtggaatgtgggagaagagatttgggagtgtcttggctgttacacatgcagggcagaggagagagaccagtgaaggttgggaggaggcggccaaaaggagacagcttcatgcccccaggacataaatagcccggctgctgcaggtactcacatgaggtgacacgactggggacagaacaggctggagcggcgggggcgggggcgggggcgggggggcgggtatcttcagaacttcagtatgagattttccccaagcacag

SEQ ID NO: 59430 - DNA, 3894 bp, Homo sapiens
  misc_feature (1099)..(1099): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacgtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59431 - DNA, 4163 bp, Homo sapiens
  misc_feature (1368)..(1368): n is a, c, g, or t
ttcctccttcctgcatcccagcctgggtcgaggatcccttttttggattgacttctgttcccttcatgcttctttctgcagtctccaagcctctggcaccatccttctcgatgacgttagatgtcctatcccaagccatttgttgcttgcatttttaggctcgagagactaaagagaactatactaactgcctgtccttctggggccaggggcaggggagcccagtctaggagaccccccaacctagacacatgtagcaaacaaaaacccagatgtaagggggtaagtgggtctggggccttccactgggtggaatgtgggagaagagatttgggagtgtcttggctgttacacatgcagggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59432 - DNA, 3094 bp, Homo sapiens
  misc_feature (299)..(299): n is a, c, g, or t
agaggtgggaccacggggagaggtgggaccacggggaggggccgggaacacagggcaagagatgactaagccagcgcactcatgctggaggaaggggagcctgcccggccttcccttcaggcctgagcctgacttgcctgtgctctgccctccagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59433 - DNA, 3546 bp, Homo sapiens
  misc_feature (1191)..(1191): n is a, c, g, or t
aggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccnggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcgcccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59434 - DNA, 978 bp, Homo sapiens
ctagttgatcaagaaaagcagtgccgtcgtttaatattcgacggcagtactataacggtctaaggtacgaggctgggtggcggctcccctactccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 59435 - DNA, 209 bp, Homo sapiens
gcctccgtatgcaggcctaccattgcttctcctcttccctctctcgttgcaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgaca

SEQ ID NO: 59436 - DNA, 1493 bp, Homo sapiens
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59437 - DNA, 1079 bp, Homo sapiens
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggtgaggcccgagggcccgcgggattccgtcttcatcccccttagaccttttctcgggacccctggccctgatcctccgacccgccgcctcctcatgtctttttccaggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagcacttgcattttgggctcggacttctctcaggcctggcctgaaagttccgggttgggacgccctaggcgatgggggcct

SEQ ID NO: 59438 - DNA, 467 bp, Homo sapiens
gttttagaattagtgaatcccccggctgcaggaattcggcaggagtcggcacggagagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggagatgcggtttcaccatgttggccaggctgatctcgaacttctgatctcaagtgatccgcccgcctcagcttcccaaagtgctgggattacaggcgtgagccaccgcacccagtctcagctgttgatattgaatggccatgcccatgacgactttgtttgtattgtattataaggctccgataaattattttttcttaacaccataaa

SEQ ID NO: 59439 - DNA, 1658 bp, Homo sapiens
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaaaaaaaaagaaaccatcatataaagaaaacaaaaaaaaagaggggggggggggtaaaaaaatctcccgggggggccattttcggacaccttttttttgaaagggggcccacagggggggtttaaagaggggggggggtaaacaaggtgggggaaacaggtcggggt

SEQ ID NO: 59440 - DNA, 1600 bp, Homo sapiens
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggtgaggcccgagggcccgcgggattccgtcttcatcccccttagaccttttctcgggacccctggccctgatcctccgacccgccgcctcctcatgtctttttccaggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59441 - DNA, 1147 bp, Homo sapiens
  misc_feature (1122)..(1122): n is a, c, g, or t
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggtcgccaatccgggngatcctctcagcagtcgcactgcag

SEQ ID NO: 59442 - DNA, 1617 bp, Homo sapiens
gcggaaatagtgtttgcaaacaggaagtgtggcactccagctaccgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcagggccatcagacttcctgcacagcaactggcttccaagggcacaaagctaatgctgccaggtcttatgcatggacccagaactggtactgtgttccttcgagttaactgagtccacggccagcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59443 - DNA, 765 bp, Homo sapiens
tcgactcaagatcggtcgactctagaggatcacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59444 - DNA, 682 bp, Homo sapiens
gttttagaattagtgaatcccccggctgcaggaattcggcaggagtcggcacggagagcaggtccaaaagggacccctgaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59445 - DNA, 693 bp, Homo sapiens
aaggggaggtgatgctagccctcacccagagaagtcctgccttgggccaaaggcgcacaaatgcacctaacccgacccccttttcagggccttttactctgtccacctgtaaatgttcctgtctcgtcactctgggaaccccaattcgccagcgtcctgtcccccctgcacccgtcgatcgcttttctatgctgggcctctggagactgtactcctgccgtgcaagcctgccaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaa

SEQ ID NO: 59446 - DNA, 292 bp, Homo sapiens
gatgttatgagttaaaagctcaaaatgaaataataacaaatttttttagaaacataatgaccaagagagaagtttgttctttttgtagtgctctcagatgtcctgggcccgactgaggcaagagtgttgacctttctgaaatccatccttgaggtccccttgacttcaaaagcagcttttccaggcgttttccctctggcctaatgctgaagcgtcctcattacccagctgtcacactcagttggcctgattgaccagagccattcccgaacacatgcctgacctgctcacc

SEQ ID NO: 59447 - DNA, 434 bp, Homo sapiens
gcaggatctagaattaagttgcaaacatttttgtggcagtactgacaaccatcacaagagaatttttaaaagttacaagatttactttgtccagaaggagaaagcacataaaatcgttgatatcagtaaatatttcctgggcatccagtgtgaagaaatgtctctgatggatcttcctcttcctcttcagtttttgtgtgccagcatatggacccagtgaacagtaatctttaaggaaatgtgggagatataaaaggcacagctaggaaacttaaaatctcttctttataaaaagaacataatagtgcttaaacaagggttattgtgcagattattatgttaatatatgtaaaatttgtagaatgatacatagcacatagtaagaagtctgtttttctttatgagtatcatcatttaatttgtagcacaatttc

SEQ ID NO: 59448 - DNA, 679 bp, Homo sapiens
ctgaatcaggaactctgggggtggagcccaggcatctggggcccaacaagcccgccccccagctgatgctaacgcatgctcaagtttgagagccacagtcctgtagtaagagtgacaagagaagcaggcattgcgggccccctggggtgtgagtgaaaggaagccaatgggcacttagccttcacccatgccacgcacctcatttacatcccctattcttatcatcttcacgaccaccttgagagccaggggttcagagcccctctttcctaatgagggctcccaggacaggatgaggtgcctgcctgaggtcacacggcagggagtgcagctccccctgccccgacctgctgagccccatcacttccgcagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatt

SEQ ID NO: 59449 - DNA, 1110 bp, Homo sapiens
cgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatt

SEQ ID NO: 59450 - DNA, 546 bp, Homo sapiens
tttacgggttaacccccgggtaacaaaggtttcccaaccctttgtggaagcccctttttaaaattccccaaccttagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatt

SEQ ID NO: 59451 - DNA, 809 bp, Homo sapiens
aagggggagtatgattcagagtagaaaaaacagcagctagactgcagaagtgatttgctgccaaattgcatggcctggtgtgttgctgatctatttatcccaccacagacattttgaaacatgcttctgcatgctcatcagaggcactttgctcttctagttcatttttatttattttctaccttccactttgaaaataagaactccgtggtagcatagatcatgtcagacttgtttacctctatatctccaacacctacagctgtgcctaccatgtagcaagttattaataaaaacttgttgaaataattgggcatgacaaacaaaaacattattcattctgttttccaattattaaaacagcttatattaaagggttttacattgtagaattctcttttctttaaattatctggtccaattctataaataatgtttattaagtttataattgtcttgtatttgtatgtgtgagaaaagatagaatttttgacagggtctcatattcagtatattctttttataaaatatatttattcgtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcaggcgcctatagtcccagctacttgggaggctgaggcaggagaatggcatgaacccgggaggcggagcttgcagtgagccgagatcccgccactgcactccagcctgggcgacagagcgagactccgtctc

SEQ ID NO: 59452 - DNA, 107 bp, Homo sapiens
gggatatgtccttaacagatgtccctgtcctttatatattagatggtggagatggatagccagaaacagacataatatatcagatgtgaaataatgccataaagaag

SEQ ID NO: 59453 - DNA, 251 bp, Homo sapiens
tacgttttatatttctaatatttctactagctacgtatgagagtgcttgttcttccacatccccatcgccaccagataagatcagttttttaagttttagctattctaataggtgtatggtggtatctgattgtgatttttatcttacaattccctaataataatattaaatgttttttttgtacttatctgtcataaatatgtcttctttggtgaagtgtgtttcaaatctgtttaaaatttttttattg

SEQ ID NO: 59454 - DNA, 696 bp, Homo sapiens
tgaactaccgcgcccggccaagttttatatatgtattgaaaagttatacacgcacacacacacgactatatgtatgactcttattgagacaataaaatgtttctatgaataagaaattaatactaaaaaataatttttaagaaatgacacagaagagcaagtacaaaatatttacctcattagtgctcagagaaatgcagacacaacaaaattatattctacattattaaattagaaaaaactttaaaaccttgatcataacaagtgttggtatggatgtgaatcagtttgaagtctcatatactgtctggggagtgttaatttggaaatcagttttggattccctgctaaagttggccatatggaagtcttaaggcccagaactcctaacatgtgcatgaggaagggtgttcatgaatgtttgcagttctattgttcatgatggcaaaaatctaaatgtccatcaggagaagaacaaataagaaactggtatatttatacaataaagtattgcacagcagtgaggatgaacaaactgtagctacatgcaggatgatggctaaatctaaaattcataacactgcatgatagaagtgagtctcagaagaatgcctaggtatgattagagtcgtatgaagtttagaaacaacaactaccaaaacagagttaatttattaatacatacataggcggtta

SEQ ID NO: 59455 - DNA, 786 bp, Homo sapiens
ataaaataaaaatttactctcttctccttccctcaaaaagtataaagagggatgcccaataaataattggtaaatgaaaaggatcatttttctgtgcttttctaccaatcctgcattcttttcactctcttagttgcccaacatcactggtttctcctcttttctatcaaaatatgttttcagacaaggatcagaaactttttcaccctgaggctcagataactaatatgagttgcatgtgctactatgcctagggacaaaagtctaaaaccaaaagtgttaaactctaataaaattagttttagtctcctttctgtggaactaatcctgttagcttcacctttaagttatgtacagtatcagaacactttattggcttctactgctatctctcactctggtctaaaccaccaccatttggactatgcctcctaaatgatctctttggctgctccctcttttatattttgcccacacagccaaaatttatgcttttaaagtcaggtcataccacaactctgatgaaacccttctagtactttctcatttctttcagtcaaagagtaaatatccttataatgcctctctgttctcctcgcctcttattctcacttttattcatcttcctctagccacattcaaacctaacttgcttggccaggctactacgtagtgtcattatgggactccatgaacattatgggactacatgaacgagtctgtacccatgctgatagaacaagatgccatcaggtatagagctgaaaagtaagcttttaacttaaa

SEQ ID NO: 59456 - DNA, 800 bp, Homo sapiens
aaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtgtcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaa

SEQ ID NO: 59457 - DNA, 550 bp, Homo sapiens
gtgaaaaaaaagtttagggattattattaaacattaccagagaaccagtttctctcgcaaatatttctttttatttatttatttattttttatttgagatggagtctcccttctgtcattttcattgatttaatttgtgtgtcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaa

SEQ ID NO: 59458 - DNA, 1506 bp, Homo sapiens
attcatcaaccaggtactcatgtttataattacttaagtggtttctgtaaaaaggcagctgatgtctgccatttatcaaactttttctcttataattgaatttagtgattctttagaaaattgagtagcaggtgattttctcatatgtataactaatttacaaggggaggccaaaaatctttggcaaagaagggttatgtcttcaatgttgttgataaatgtaatcttactttctacgtagcagaaaaactctgttgagagcttccttctccccatacattacaaaagacctggaaatttggtttcaaaaatgagaaggggaaacactgttcacagtaactgcagtgccccattctgccaatggaatttgatgacacttctatcattcatgaatttgttcaatagctctgtttggctgtgtatacctgtgtgcatgctgttcttttctgcctaggatggattgccatcaacattatatgctcagagtctaattcattcttttactcagtgggacagtcttctggggtgcattccctgacttcacagagatgtaggaagtcttttctccatgatgcctttctatcttcatcagaacaacattactctcgaaatgatttgtttacctgccaggtgctgagggtgaaaaggtaaatgagacagagtgccccccaactccccgcctacaggtagtgtatctcaatgaataagtgatattttaataaatgagttgaagaaagataaaacaagtaagacataatacttgctcttgagagtttgtgacaagcttgaaaaataagacatatataaatagatataattataataaatggacgtttgtgccaaatgtcacaaggcagcaaagaaactagtttgagaatccagaagagaatggagctgagtcagccagctgaagcaagtttggaaaggaaaaactcaaattgtaagctgatttagggtgaaatattgatggaattatccattctatcatgataagaatcaacagcagttgtaaattgttttctatatggtagacattgtaccaagggctatacatacattgtctagtttaatcgctccaggcagactcctaattcatttgagtaatggcccctaactacttcatgtgtttgttttgtgaataaatgggcatgttaatgcactttggaaatgatagagcataaaacaaaaatctacataattattctgaaaagaatggatgacaagaaaaataggacttcacagagggaaggatgatcaaaaaattacgatattgggacagaacaaaaaggtgcactattggggctcaaacgcagatggcttacaaagaaagtctgaatttgaaggatgttgagaaataaaagtatctcaaagacagtcccttggtgacagtaaaaattgagaccacttggaatgaattaaagtggagcaatagtaagagaagctggagaacaggactgacatagaaatagtatttaaaagctgtgaaagcacttcagccaagccttt

SEQ ID NO: 59459 - DNA, 649 bp, Homo sapiens
ttaaaaaaaaaaaaaaaaagaagaaagaaaaggcaagaaaatctaaagaagtaagaggaaaaaaagggaaggaaggaaatagaaacaatgtctgtgataaataagaatgagagaaggttcatgtggtagggagtgccatccattatcagttggcatctcctcactgacagagctcccacatgtgtatagctccctttcttcagccatgattgacggcagagctactatttttgtgggaagaagactgtgacttcttgggttgaaagagccagattgaagttctctgtatgtgagtcttggaaccctgaaaaggtgcatgatgaaaaaacagcaattatgttacagaagccagtggaggaatctggcaggaatgggtatggacatatctttagcatgaaccaaggatgaaattttactctgtatttcacagtcaggtttccaagtctacttgagacatttggtgtctattcttgtttatattggcaaatcatagtttcctttgtgggtatgctttaataatgaacttgaagagaaaacagaaatacctctagagtttttggatggcaaatggatcttacaaaacatttttaaataatctaagtataaaggattcaaaagcatatagattgaatttctcaaaaaatcaagc

SEQ ID NO: 59460 - DNA, 158 bp, Homo sapiens
gcactccagcctgggcaatagagggagactccttctcaaaaacaaaacaaaacaaaacatatgaatggataaacaaaatgtggcctatccataatacagtgcataattacaccataatgcagtggtgtgtttttcagccatggtaaaaactaaaattc

SEQ ID NO: 59461 - DNA, 417 bp, Homo sapiens
tagacagagcctcactctgccaccaaggctggagcacagtggcatgatcttcgctcattgtaacctctgcctcctgggttcaagtgattctcatacctcagcctcccgagtagctgggattacaggcgtgcaccaccacatccagctaatttttgtagttttagcagtgatggggtttcaccatgttggccaggccggtcttgaactcctggcctcaagtgatccgcccatctcagcctcccaaagtgttgggattacaggtgtgagccactgcgcccagtccactttaggtatccttaacccaattttaaagataagcaatggaggcacaaagaaacaacctgcccacaactaaatagaaggtaacagctggtaacgtgacagatttgtacccaggaagactggggttacttctat

SEQ ID NO: 59462 - DNA, 418 bp, Homo sapiens
ccctgggttgaacccaagaagctctggactcagagatagctggagctaagagatgtatgaggcatcattctaaaacaggaaactattttagaattaaataaagcctcttctttgaggtgtgagatacccaggctcctcccttcttgaatcctagaattagaaaggagtttgtaaacgtaatttctgcagctattggcacaagagaggagctcttcagagactgacattttgggatttgcaaacaaaatggccaggtcaccaactgaacaccctacttacctgttagcaaacctgcccatgcagaatgggctttcaactagcttttcaaagtcttactcttaaatatggataaacaaagattatgtatgattgaagaaagctttgaacttaatgagaaagtcaaaatgacaaacaggat

SEQ ID NO: 59463 - DNA, 577 bp, Homo sapiens
ccttggcatatatttccaaacttttaaaggtttctcatattctagaaactcaagagttgtttgtataggaaacaggggcctggagttattggtgcatattccaatggcctcataccttctttctagaattttgttttatgtaatgcagtttaagaagatgcactttcatcatggtgactaacccaaatcctgatagtgacttttgggacatgatataaattttgtatttatgtaaatataagtatacattcatataatataaaacatattagatatatattattttgcatatcagtataaacattaatatatatttatatagttctattccacagtgatgaagttttacaaggatggagcaagaagtgccagaattaaaatttcaaagtgatcagtataattgattagtaattaagttgcagaaaatatggatagtaactggcaacataatgctctaattattcctattagtttttcaaagaatggcaacaactaaatatgcttctgagtgtctcccctactattttgtcttttttaccaaattgagttctttaagggtttcaattacctattaaac

SEQ ID NO: 59464 - DNA, 3225 bp, Homo sapiens
ttccattggcccggagaggcggaggcctcgggcggccagccgcgcctcggacgaccccgggacagatccgggccgcgtccccgcgttgggagagggatggggactgaggccggagacgcctagacgccgcggatagcgaagtctgagttcctctgagccagggggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaaca

SEQ ID NO: 59465 - DNA, 3223 bp, Homo sapiens
ctgtggcattgacagactctgttcacaatgtgtggcatcaagaagctggcaaaacgattcgagaatggatgagagagaactgttgtaattgggtctctagctcagaaccattagacacatcagtggagtccatgctacctgattgcccccgggtctcagcaggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaaca

SEQ ID NO: 59466 - DNA, 4064 bp, Homo sapiens
ttccattggcccggagaggcggaggcctcgggcggccagccgcgcctcggacgaccccgggacagatccgggccgcgtccccgcgttgggagagggatggggactgaggccggagacgcctagacgccgcggatagcgaagtctgagttcctctgagccagggggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaacaacagcggtgttattattcttgctcagaagaattcttgcttattcaccaattgcatagagattttttaaagcaaaaacataaaaggaaggatgagacagcatccgtcaatattttaaaccttctggctactttttatttctgttagtattgctgtaaggtaatatcctaactttagttgagtcactatttggcttgcaccttttacaaagctaacatttctaagacagttgtttttaatatctaaaatatctccttagcaaggaaatctgaacaacctatcaattaaattgttgttttataaaatacacttgaatatgccataaataaatgtgttttccaagaggagtctggtgagtttaagttgcctccaagtacatgtatataggttcttgatgtactgtgttcgatctgaaaataacttacatttcttttacagctttcttaaaacctttagccccttttagagatatgctaactgtattatccgtgctaataagttagattttgtttgtttctctggattatctgcggttcaatccaaacacgtgtgtctcttgttataatcatattttttactgtaaactgacaggttcctgttggtgtctgtaatcctaattcatttaagaaagagtactactacagaaagtgtaaaaatttctcaaaaactttccacatgcctctgtggagaaaaaaaaatgtctttaaatgtgagacactctcatctttgaaatatgggtggcaaaaagggggatgatggtggtggttattttattattacttattagtggccataataatataaaataaaagactccaggaggtactccctttcaaaaatt

SEQ ID NO: 59467 - DNA, 3171 bp, Homo sapiens
ttccattggcccggagaggcggaggcctcgggcggccagccgcgcctcggacgaccccgggacagatccgggccgcgtccccgcgttgggagagggatggggactgaggccggagacgcctagacgccgcggatagcgaagtctgagttcctctgagccagggggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaattaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttcccaaca

SEQ ID NO: 59468 - DNA, 1960 bp, Homo sapiens
ttccattggcccggagaggcggaggcctcgggcggccagccgcgcctcggacgaccccgggacagatccgggccgcgtccccgcgttgggagagggatggggactgaggccggagacgcctagacgccgcggatagcgaagtctgagttcctctgagccagggggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctc

SEQ ID NO: 59469 - DNA, 2405 bp, Homo sapiens
ttccattggcccggagaggcggaggcctcgggcggccagccgcgcctcggacgaccccgggacagatccgggccgcgtccccgcgttgggagagggatggggactgaggccggagacgcctagacgccgcggatagcgaagtctgagttcctctgagccagggggcaccgaccgtcacgagctaacttcctggaagagctttccgtctattttcaaattctttaccgaagcctcagaggccaagaccagctccctgaagccggctgtgacgcgccgctcccaccgcatcaagcacgaagagctgtaagaggagcgagcgcgacgggggaggccgccctggcgcacccacccgcacgcctcctcactgcttgtgtcgagcggactcccagcccctcattagattgttttcttcccagagcccagggtcgtgatatatacatctaaatagcgttttgcattatttctagatgagtgcaactgtcaaagcaatatgggttcactggtcgtgcttcctgcgggctgagcgcgggctgagcgctgccagtcagcgctcacattaaggctgacagcgccctgcctggctcggccggcgaagctctaattgccctgaaggagaccgcgcgggcgctgcgggtccggcggcgtcggcgcggtcctagcgcccgccgtagcggagccgctgctgcttccccctccttaatcatgtccatctttccccgctctcaactggagcaaacttctattccagacttcagatttccattttcactaggtttttccctgagggcatcttattacccacctcttttttttttttttttaaggaagttccacacacactccaaagccgatttcaaattcagaacctgaatgccatgatgtaccatgtagtttggggaatgcaaattgttctctccctgttttcatttcgggaccagaaaaaaaaacaactctgcataaaaatctataaagtactgaatccgcattactgctgaaaatccttttgccagctaattgtgagagtttacacaagtctctgatttcagaagagactgttaaaaccaaaacaatgatgggcagctcttttaagtgtaggtgtgaaggtcccattttcaatggaatttccaactgttatcactgggattgactttactttttaaacacataatgtgtactgtgtggcattgtaatttagatataacacacttaagttttgctttttaaatctctctgtggagaaaggttgttgttaatcctttccagaatgatctattctgagctttcctggagttaggcccttctagggagagaatttttttattgtcatcaggaaacgaaacctttgtgctctgcagcctttttcttctgaaaggctaagtggggctaaaattatccttttagttttctgctttaacaagaagagaaggacttggtgtgaaagaatttcttctctcagtccaatggtataatttttagcactccgcttcctctgtagggtttagccctacagtttgaacaattattttaatccagctaagatgtggccaacactgtgaaatacaggagatgttaaggttttgctgacttttagattaaaatcttaaaatttcacattatattttaattacttgaaaagtttaattacctagtaaagattgtttctaatagatgagaacataaatttaatagttttcatccttttttaaagtgtgtgcaacaattaatatgcctgccttatttgaggacatgataaaatgtacccaaaatgacttcgaactgtctaatgcctcagaaaagtaacttaaaatcaaccacttcgtgcttaaatgtttttatattatgaaccgatttcaacaagttttaaagctgttaatatctcattgctgtgtttgacatacaagtacattcattggttctatagtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaacca

SEQ ID NO: 59470 - DNA, 3313 bp, Homo sapiens
  misc_feature (1505)..(1505): n is a, c, g, or t
  misc_feature (1533)..(1533): n is a, c, g, or t
ccagggccggtgtctccaggagagggccgagcgcacagcagctctaggacctcgcaggcgcctcggcgcggcactcacgtagagcccaaggagcagtccccgacctctcctcggagggccgtgcaggcttccccggcggtccctacctgcgcctccgcccgccagcggcgctggggaaggggaggagcggcccggacgctgcccgccgcgcgcagggagccgcccgccgcaggccttgccgccgcccgcccgcgctctccccgcgagccccggagggcgggtctgcggccgagccagcggcggcggaggggcagcgcagacctctgcggcccgggcgggcgcggcgcgggagtcctgggccgctggcgggcaacgcctctgcccgacctcgctggggaaggctggcgctgctgcccggccggagccaggggcaggctgcgcaaaggtgacttagggagaccttgcgggccgccctgggtcgcgcctcccggatcggctcgcctcggctcgactggaggggaggaggaggagcaggccgagcgcattcgcgctggagcttgcgaggagcgcagggtggagcgcgccagccggggtcctcggatctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtanggcaatgtggaaattataaaccacaagnctggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttcccc

SEQ ID NO: 59471 - DNA, 331 bp, Homo sapiens
tttatttttttctttatagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcaggtaactctgggatccttccctctgcattgttggtgatttaga

SEQ ID NO: 59472 - DNA, 3340 bp, Homo sapiens
  misc_feature (1532)..(1532): n is a, c, g, or t
  misc_feature (1560)..(1560): n is a, c, g, or t
agagataaggtaaagcatcattaatgaatggagaagtcttctgaagtgacaccagtgccttatccctagaggaatatcagcatagaaagcacagtcatgccaacagcgactagatagggaaatttccaactttctcaaaatgattaaggagtgtgacatggctaaagttctcaagagttgactataaatagcctacaaggctgggcgctgtggctcacacctgtaatcctggcactttgggaggccgaggcggtggatcacctgaggtcaggagttcaagaccagcacggtcaacatggtgaaaccccgtttctactaaagatacaaaaattagctgggcgtggtggcacgtgcctgtaaccatctactcaagaggctgaggcaggagagttgcttgaacccggaaggcggatattgcagtgacccaagatcgcgccactgcactccagcctgggcaacagagggagactctgtctcaaaaaaaagaaaaataaatagcctacaaatcaaacttaagtattgagaaataagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtanggcaatgtggaaattataaaccacaagnctggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttcccc

SEQ ID NO: 59473 - DNA, 3459 bp, Homo sapiens
  misc_feature (1651)..(1651): n is a, c, g, or t
  misc_feature (1679)..(1679): n is a, c, g, or t
aggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtanggcaatgtggaaattataaaccacaagnctggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttcccc

SEQ ID NO: 59474 - DNA, 614 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 59475 - DNA, 648 bp, Homo sapiens
  misc_feature (632)..(632): n is a, c, g, or t
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaagtcgaccggccgngaatttagtagtagta

SEQ ID NO: 59476 - DNA, 934 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 59477 - DNA, 476 bp, Homo sapiens
cctagactaaccacgtttgtgttggtcctccgctgagctgttaatccagggaagagttgcccttctgaagaatatgtggatttaatggagaccaagacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 59478 - DNA, 1379 bp, Homo sapiens
  misc_feature (1081)..(1081): n is a, c, g, or t
  misc_feature (1379)..(1379): n is a, c, g, or t
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaaaaaaaaaaaaaaaagaaaaaaaaaaaaaaaaaaaaaaaacaaaagaaaaaaaaaagcgggggggcggacccaaaaaaaaagcccggagggagggaacaaggacatgagagcccacaccatgtgtggtacaagagaagcggcaccaaaaaggagaaccatactaaaacacacagcgcggcgcgcaagaaaaaaaaacaacgacaagagagaaggaaaaaagatcaagcaggagacaatctaggaagaaagaaccccccacaaacgaggggggggaaacacacagagggcgaaaaccacaacaagagaaaaaagcacgccgagagaaaaccataaccgcaccgcgcaacacacatacgtgcgtgacaaccacacaagcgacactgcccgcggcgggaaagaacaagcgtacgccacagacgcgcgcctgcttcatcaacaatacaaccgggaggagntacagacaaccaacacacaacaacacaaacaaagaccacacacagcaggcaaagcaagacacaaccactcacgccagaacagcagaaacaacaagagaaacgaaaagaacaacaaaaggaagagaaaacgaagaagaaaaagaaaaaaaaaaagaacgaagagaaaagaggagagagggagagacgaacaaggcagaaacagaaaacggaaacaaaagaggaacacaaagagcacagaccaaaccaacgagaccaacagaaacaaagaagaaagaagcgcacgaagaaagcacaaagn

SEQ ID NO: 59479 - DNA, 366 bp, Homo sapiens
gatcgacggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 59480 - DNA, 804 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaagaagtcttgctcatctttggttcacttccttcccagacacacacaaactcagaaccacacagccagtctcaggagtccagtaatggagagccccaaaaagaagaaccagcagctgaaagtcgggatcctacacctgggcagcagacagaagaaggccaggatacagctgagatcccagctcggcgaca

SEQ ID NO: 59481 - DNA, 556 bp, Homo sapiens
gatcgacggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaagaagtcttgctcatctttggttcacttccttcccagacacacacaaactcagaaccacacagccagtctcaggagtccagtaatggagagccccaaaaagaagaaccagcagctgaaagtcgggatcctacacctgggcagcagacagaagaaggccaggatacagctgagatcccagctcggcgaca

SEQ ID NO: 59482 - DNA, 402 bp, Homo sapiens
cctcgtcatattttggaggcagagtctcgctctgtcacccgggctggagtgcagtggcgcaacctaggctcactgcaacttccacctcctgggttcaagcgattctcctgcctcagcctccagagtagctgggactacaggcgcccaccgccatgcccggctaattttttgtattttagtagacacggggtttcaccgtgttgcccaggctggtctcgaactgagctcaggcaatctgcctgcctcggcctcccaaagtgctgggattgaagacatgaaccactgcacctgtcctgatttcatgtttcttatgtgccatcactgtttctaatgttcccttctatgattatgcttacactaaattctgatcatttacctacgacccttcctattatagtctga

SEQ ID NO: 59483 - DNA, 418 bp, Homo sapiens
tgaccatagaggatcccgtgatgttatcgcccaacacacactctctcttgcagctatggatggccctgtatgttagttttggcccatgagataaaagtagaactctgatggggaaacttttgggaaagcttctgtttcttcataaaatgggacagatgcaactgatacagcctgtcctcatctccctaatttcctgccttaaacatggatgagatggcaggagctgcatcagccatcttgcagccctgagggagagagaaaggcaagtgcagagacatcagcattgagtactgaacctgtctctggatttcttgctatgtgggaaaagaaaaccttcttggcttaagctactgttggttttctgttacagtttcatgcattcttaaatgatagatccctgagctaggtgttgggcata

SEQ ID NO: 59484 - DNA, 331 bp, Homo sapiens
tatgatcctctgcaatctggcctcaacccatctctccagctgtttcccatcttcccaaactcttgacctcaggtatacgcatctttacatagtctccttgcaaaagacactgttgatcagctacctcagagccattctaaatattcttcttccttgctgctcctcactatagaggctacaaaacccaacacacactctctcttgcagctatggatggccctgtatgttagttttggcccatgagataaaagtagaactctgatggggaaacttttgggaaagcttctgtttcttcataaaatgggacagatgcaactgatacagcctgtcc

SEQ ID NO: 59485 - DNA, 417 bp, Homo sapiens
atggatggccctgtatgttagttttggcccatgagataaaagtagaactctgatggggaaacttttgggaaagcttctgtttcttcataaaatgggacagatgcaactgatacagcctgtcctcatctccctaatttcctgccttaaacatggatgagatggcaggagctgcatcagccatcttgcagccctgagggagagagaaaggcaagtgcagagacatcagcattgagtactgaacctgtctctggatttcttgctatgtgggaaaagaaaaccttcttggcttaagctactgttggttttctgttacagtttcatgcattcttaaatgatagatccctgagctaggtgttgggcatacaatggagaacaaagcaggtatggggctcctccttatcaaacttacagtcttgt

SEQ ID NO: 59486 - DNA, 586 bp, Homo sapiens
agctcactgcttattacctggtagatttgtttctatcacttaggcctgtttaattacataatacatggttgtagcttatttctttagtagtgataggttcttgaaccgtggaaatcaagcagccataaatgtttaaaaaggaatccgggccagatttattcaaaggaatccgacatttgtaatatgaagactattttaaaaataaccagccttttgtttaactattttgaagtccagagtttccttattgttttttaatgttgggcatttgtttatatcatttttattgatttgaaattaatccagtggtgtatatgcatgagggtagttgctaggctcggttttggagaaagatcttcactagaggaaaaggaaaacctaaagctctgtttaagtgagggaggaattttggacaggcatcctcagtgatctagtattttgttaagagtatgggaaagagatatatttttatcctggagtcattctgagtcttatgctcatcagaaattcccatgctttagtttgtgtgtgtgggaaagagatgagagagagaaagagagagagagagaaaaaaaaaagaaaaaag

SEQ ID NO: 59487 - DNA, 652 bp, Homo sapiens
tggagatcctgcagcagaaggtggccggggtgcaacgggaactggaggactttaagaaagaggcattgaagtccattcattaccttgaagacgccttctgcgagatgaatggagccctggtgcaacaggaggagcaggcggctcgcgtgaggcagcggctaagggaggaggaggaccgtggcatcgtgcgcaacaaggttctcaccttcctgttgccgcgcgagaaacagctccgggagcactgcaagcggctggaggacctgctgctggacaggggtcgtgacgccctgcgtgccaccaagaagagccaggctgactgagcctcgtgggtggcactagccaagcaccaagttgaagattttttttaacggaaggagaaaccccaagtccctacccccttgctttcccttcctcatttccattgctttccttctgcctaaataacaccttgctgagaggcaaaaagacttcaatattttttttggtgaaattccatttatccagcattctaaaggaaggaggcaccccagtactgagtcaggcccctgtaactttcacttgaactgttttcctgtttgtaatggtactattgctcaatgtatacctctttatttgtatagtatattcttaaactgattgtgttgaacattca

SEQ ID NO: 59488 - DNA, 865 bp, Homo sapiens
taaacagagaagagaaaaaccgtgttttgagatggattggaggcattttttgtccacacacttgctttggggatttttattaggtagacggtaattagaggtgtcagtcatatgaaagtaaatcactagtctttcgtattactgttttctcagtggtccttatcagttttttttgttgctctgtaatcattcatatggtaagacttaacttttagtcatgtaaatttgtttagggacaatttaaactattttgtcaaattagtcgttttattccaagttgtacgtcttatgcatttatttagtatagtgaaagccttatatacacatttaatataattagtctctggatatttggattattttttagtagtacttttttagagtgtgggttttttcttttcttttctgtttttgagacagtgtctggttctgtcacccaggctggagttcggtggcccagtcttggctcactacaacctcagactcccgggctcaagccatccttccacctcaccctcctgagtagctgggactacaggcacttgccaccgtgtctggctaattttaaaatattttttgtagagacaaggtttcatgtttcccaggctggtcttgaactcctaagctcaagtgatccacccactccccaaagtgttgggattgtaggcaggagccaccacacctggcagttttttccttcttgttttgagatggggccttgctccatcacccgagctggagtgtaggtagcatgatcatagctcgctgcaaccttgaaatcctgggctcaagcgatccccctgcctcagccttccaagtagtggggactattggtccatgccaccatgcttagctaattataaaa

SEQ ID NO: 59489 - DNA, 649 bp, Homo sapiens
agctcttatttttccctttctaccaaattgagagaatgggcagacacaggagccatattcctagtttcacagaaatgttacttgaattattattttcccttctttcccaggatttgcctgtaagcattcaaattgttttgaatttcattttgccttctctaagttagaggtatttaatgactgaagactggcaggagagaaagtatcaacaaactgagtaaactattcttgaggggcactgaaaagatgttctttgaaacttgatttatatatttttacttgcaaaagaatatactgtgttttgagtatgaaagtgtgattgggtctgttgtgggaaccactgactgatgccataatttgcacttaaaggctataaattacatagttagccgtactttagtactagaaacagtaaattgacatccttgaactaattcctaccttttttttgtttctgaagaaataaagagtatattaagcaaagggataatttatatttcaggttggacaatttaccctaaacaaattaaaccatggaaagtgcaaacacatgaatgaaacatttttttacatcaaagtatcatcaaagattcttgtttcatttgataaaattaatatttgaataaaaaaatttttaaatcaaaaaact

SEQ ID NO: 59490 - DNA, 364 bp, Homo sapiens
ggaggttgcagtgagccgagattacaccattgcacacagcccgggcaacaagagcaaaactccatctcaaaaaagaaaagagaccaagcgtaggcacttcagatgacaatcccagctcagcttccagctgatagtcagcatcaactacatgctgcataacaaacaacccaaaatctcagaggcttacaataatagagacatatttttttgctcacagctctgagggttatctagggtatctctgcagctgcagattgactgggctgcagctggagtctaggtctgctccacatgtctcttcattctctttggaccagtgactatttgagatatgctcagggggggggggggggggggggaattc

SEQ ID NO: 59491 - DNA, 388 bp, Homo sapiens
ggcgtgagccaccatgcctggcctagaattgaaaattttgaaatagatttggcatatattttataggcacagggaggaaaattttgatgacctctgtgtagtgaagggcgctatataaaatggcttaatgaataataaagtagatcaaatgtttagcattttcagtttatatttttatcttgtgtgagctgtttctggataatttccgtttttagtatgtcactgacttcttatgtcactaagatatctgacagaagctaaggtaatgctgttgaatctccaatgtggacagaaatcttagacaacctttcatgctattacaactttgaaggttagacttttaaggtttgacagactagaataccccttccacttgtctggttttggc

SEQ ID NO: 59492 - DNA, 384 bp, Homo sapiens
tgtttttaagacagtgtctcattctgttgcccaggctggagtgtagtggcaccagcccagctcactgcagcagactcaaacttgtggggcttaagcaaccttcccaactcagcctcccgagtagctgtgactacaggtgtgtgccaccacacctggctattttttaaattttttgtagagatgcattctccctatgttgcctaggctggtcttgaactcctgaactcaagcagtcctccctccttggactcccaaagtgctgggattataggtgtgagccaccacgcctgactgctgctattgtcaatagtgctatgctaaacgtgcaaatggaggcatccctttgatatacagatgcttattcctttgggtaaatactcaaca

SEQ ID NO: 59493 - DNA, 328 bp, Homo sapiens
aaaacttagaaatgacagcaagaggggcaagtgaaagagacagtggcagtcaaggctactggaaccagagagcatgaagggctgcatctgagagcgcaacagagctcagaaggtatgaagagaaggtgttggcacaaggcttcatgcactgtctgcagacccgtgagccaattaaacctcttttctctataaattaccccgtcctcaggcacttctttatagcaatgcaagaaccaacctagctcaactgtttatatagtcaattggcttgtgaaaccctgcctactctaagaagccttcctggattaagaggaaagggctggaatct

SEQ ID NO: 59494 - DNA, 754 bp, Homo sapiens
tcctattgtgttaataaaacaaagtcagacaaacgtaattgcctggctaggtgattttcttttctactcagtgcatttagtgtatagccatgaagtttaaaaaaagtgttaaaagtgtatctgtaaaaacaaccacctgaaaaagttattttagtagttgcagtgaaaagctagaattcatactgtttcatatagggaagtatttccagtgagtagtgttttttggtcagaactaaaaattgagctggtttattccattttaccatgcctgtactgtagaggaaaggggaagtatatggaatacacttgtgaatacagtgtgtaggatacattaacagttttctgagtgggctgctcttttttcctcaatactgtatatatttttcttaagctcttctttaaaagataaatatttttcatacttctcttaaatcctcaaggattaactctgagtcaccatttgtggtattttaaatccttttaaataaatctctgtatttgcaactgaatcaaaacagtaaaacatttcacagggtaggatctgatgaccattttataatcaacatttttagataccacaagaggtacttatgagcatccactgaaattatggcattatgtcatataaatatccaaaaattcatttttttattcttatgtttatatataagaaagaaaaggctgggcacggtggctccctgtaatcccagcactttgagaggccgaggcagatggatcactaagtcaggagatt

SEQ ID NO: 59495 - DNA, 329 bp, Homo sapiens
cttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatctacctcaaagggctactgtgtgactccaatgagataatgtgcaatgaagggtttcgtgtaatattg

SEQ ID NO: 59496 - DNA, 362 bp, Homo sapiens
gttctttatcttcctcctcttatgtgcactatgtaatgtcctcatcattttaaaagtgagttgctattgggcgggcgcggtggctcacgcctgtaatcccagaactttgggaggccaaggttggtggctcacttgaggtcaggagttcaagaccagcctggtcaacatggtgaaacccagtctctacaaaaaacacacacaaaaaattagctaggcatggtggcacacacctgtaatcccagctactcgggaggctgaggcacgagaattgcttgaacccaggaggcggaggttgcagtgagccaagatcgtgccactgcactccagcttgggtgacagaacgagactgtctcaaaacaaaa

SEQ ID NO: 59497 - DNA, 329 bp, Homo sapiens
agagcgtgtggagactcacactgtaatcttttgctccaagaaccaccagaggaatgtatcaggaaaaccaaaagaattcacagatcctttgaaagaggcagtacactgatgcaaattccatgaaatggtgaaaagctgtgagttcccagagtgtgacgggggaaaaccagcctccaaatacacattcctcctggggaatctgaaaatccagattatgggagaaggatttaaccttacctagagaagaaatgaatttagagagtagtgcaaaatataaaagtagaagtagcatcaggaaagtgccttgcaggtactcccagtatccagct

SEQ ID NO: 59498 - DNA, 329 bp, Homo sapiens
  misc_feature (129)..(129): n is a, c, g, or t
  misc_feature (137)..(137): n is a, c, g, or t
  misc_feature (233)..(233): n is a, c, g, or t
  misc_feature (236)..(236): n is a, c, g, or t
  misc_feature (241)..(241): n is a, c, g, or t
  misc_feature (247)..(247): n is a, c, g, or t
  misc_feature (252)..(253): n is a, c, g, or t
  misc_feature (258)..(258): n is a, c, g, or t
  misc_feature (275)..(275): n is a, c, g, or t
  misc_feature (281)..(282): n is a, c, g, or t
  misc_feature (290)..(290): n is a, c, g, or t
  misc_feature (295)..(295): n is a, c, g, or t
  misc_feature (304)..(305): n is a, c, g, or t
  misc_feature (312)..(312): n is a, c, g, or t
  misc_feature (317)..(317): n is a, c, g, or t
  misc_feature (326)..(326): n is a, c, g, or t
catatgcaaacctttactttatccagccattatgaccaatggactgtgcatccggctatgtaggtggtcttcttcatgctttaatccatgaaggatttttattcagactaaccttctgtaactccaacntagtacancacatttactgtgacattatcccattgtctaagatttcttgtactgattcttctattaattttctaatggtttttattttctcaggttcaattcangtnttcancattgngactnntcttntatcttatacatttgtnctcttnncaatcttnaaaangaaatctgnnaaaggtntaagnaaagccttntcc

SEQ ID NO: 59499 - DNA, 337 bp, Homo sapiens
cgcacccagccacaaaattaatacacaaataaatcaatagcttttctagatagttagaaaatataatggaaacaaagatctcatttataataaaaacaaaaaatgcctggcaacaaactaataataagtgtgcaagatccaattgctgaataaaaaacacctaaagttcgccagggatacaaaaggaaacttgaataactggaaaggcataccatattcttggataagaaatttcaatattaaacatttaacctccctaagttaacataaaatgtttcaacataatctcaatcataataccaatagtttttttgacaagaaaggctgttcatgtaaa

SEQ ID NO: 59500 - DNA, 1084 bp, Homo sapiens
cagacagcagggaacatcaccctcttcagactggagtcagtgggaacagacccaagatgttggggaggaacacttggaagacctcagctttctccttcttggttgagcagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcaggaattagtggtgggcccttggaaaaccactacagactgaagcaatttcacttccactggggagcagtgaacgaggggggctcagagcacacagtggacggccacgcgtaccccgcagagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatg

SEQ ID NO: 59501 - DNA, 312 bp, Homo sapiens
ccagggccttcagagggcaatctacttcgaaatctcacagttctaaccagcttgaacccaaaatctacagggaacaaaattctagggagcaactcccagcctaatgattcagccaaattagtcatcccatgtaatttgcatgtggaattttcatgaaccattgaaaagtttttttaaaaaagctttgttttgaggctgggcatagtggctcacacctgtaattccagcactttgggaggccaaggcaggtggatattgaaatcagaagttcaagaccagcccggccaacatggcaaaaccctgtctctacta

SEQ ID NO: 59502 - DNA, 787 bp, Homo sapiens
  misc_feature (722)..(722): n is a, c, g, or t
  misc_feature (724)..(724): n is a, c, g, or t
  misc_feature (728)..(729): n is a, c, g, or t
gtcgtacacatatcctccactcattcatggaggacctgcaatacagtacagcaaggagcgtaccctaggaaggcaggggaaaaaatctaccttttagagccctgtaatagagttccattatgtctatataagtgataagttgcatatatttttcattgttttaattattaataggtaacagttaatataataagtatcaaatgccctcagtgcatacaaacccaagtttaattatccaagtgaaaatgcttttgtggattgactttttaccccctcttcctcaacaacacatagtagcctcatacacaaccccttcccacactggtacacaagtatgcaaatagaaacacagacacctgcccataaacaaatcaccctggccaaatgccactgcctttgggtaatgcagggttcttcggcggaatatttcttcttctgctcctctggaatgtattccattccctgctgctctggaatgtaaccatgtgagatttcttcccctttttcatcacatggatgtctgttagaattccttttctggccgtgtttctcatgtgtaggcaatactttttatcatcttccacatttccgttttccttcctacttttgcctagttgctttatgaaaatctttatatctctccttagcccttggtcacttcatgactgttgtgaaccattttcctaccttagaagcatgatgtacacctaaaaattattttntncttnnccaaaaaaaatataaaattacctcacctaaaaaaacctttataacggaacgaggtcgg

SEQ ID NO: 59503 - DNA, 302 bp, Homo sapiens
aaaaaattgttcatggcatgcaaattagaaaatgagaaattggcggttcccattagcaacaaatattctgagaagagtttcatgggaggagaggccatatacatcacgtttataaatatttttacttcccagaaaaataggagctaggattgcagcagagccaagccctggcagccctttcgggcgtccccaggcagtgccctgaagcccaggctcgccttttgtgcttcctgcgtccgctccaggcgtgtctgcgcggtgcggaggcgcatccccgccaggggagggctgggagcggccgc

SEQ ID NO: 59504 - DNA, 454 bp, Homo sapiens
aagatcatgccacagcactccagcctgggccacagagcgagactctgtctccaaaaaaaaaaaaaaaaaagagggagctgagtgatgagtgcctgaataatgaaagatgaatagtgacagtacaaaatatgaccctcttttagggtgttacaacctctttcctctcacctcctccctagtgttctcaatgcccatcatacttctccctctatactacagtaatctggatactcccagctacactcttaccaggactgataagaagtgaagagacttaagcaaagggcaggacgagagcccaggactaggaatcctggtgctggggcacgcatgcccaagagagacagtaaagagattttcataggaacatcttgaccctggatgcccatagaaaatggtgggacagcatgggactacagtcttcccacggtattcaggggggattagttccaga

SEQ ID NO: 59505 - DNA, 353 bp, Homo sapiens
gttccctgaggagcccctggaagatgggggagggatgagtcctaacggctcaaggacccgaggctgctccctggggcacagtcaaccccaggatcctttctgaggctgtctgccttctccctccacagccacacgttgcttttagcttgctgggattcacacttgaatttacggggccaggaaggagtgaggcaggaagcgccagtgtggcttctgcagttggggaataataacccggccacttccaagcagacttggagcatgtagcgcccagctcagagatgagggcaggctctcctgagaggtcagggacttagcaccgtgatcatgattgtcagtcttatgtgatgatc

SEQ ID NO: 59506 - DNA, 779 bp, Homo sapiens
agcgtggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaacaattaaagca

SEQ ID NO: 59507 - DNA, 750 bp, Homo sapiens
aatgacccactgtggtcatcttggaagcctcggcccatccctgctggctgtgctccattcttgtgcctcgccattggaacgctctagtgagccggaatgaagttcaggcccatggctgtgatgtcacagaacatgtgaagtcagaggtcctatggaaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaacaattaaagca

SEQ ID NO: 59508 - DNA, 662 bp, Homo sapiens
agcgtggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctcccaaagatgggagccagacagagaaaacgccctttgcaggccagagacagcagacccacatccttctctcccacacctctcctggttttgttcaggacagcagattagaggcaggaggcaatgacaataaaataacgataaaatcctgagaacaattaaagca

SEQ ID NO: 59509 - DNA, 714 bp, Homo sapiens
aaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctac

SEQ ID NO: 59510 - DNA, 194 bp, Homo sapiens
aagaagagtcttctgcacaaacaaaaccatagtgttgacaaatagtcatggccaatggcaatctgatggtccagggccctggatgactcctctgcaggagcatcttcagggttctagggaagtcacaggggcaacatattggaaactagcaggcccagaagaccgccccgccccccatgccctggcgcagggcc

SEQ ID NO: 59511 - DNA, 1010 bp, Homo sapiens
taggaaaagcagcaaaccagatggagaaggaaggccaaaaagataagtagaaagctggaccatgagctccttgagggcagggactgaatggttactatgtccccagggcccagcatgaccttctcctggattcctcatcttccttctgtgacctgtgtctccatcagtttctcctccggcatctttttcttacaggattcttacctcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59512 - DNA, 900 bp, Homo sapiens
acagcagagatctgggcctgggagggagagagtacacaatcacatggctgttgcccctgtctcaggccttgtctacctctgactgtggctctctggcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59513 - DNA, 860 bp, Homo sapiens
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59514 - DNA, 988 bp, Homo sapiens
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccaggtgggagctcctcaagggccctccccaggaagtgttcctctggatgacctacctggggcagaggagccagaatatggaggagatggctgtggtggggagagacttagtcctgtgtcttccccacccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59515 - DNA, 543 bp, Homo sapiens
gggtggtggacgccctgccccctcccacagctctggtccccttcaagggtaaagctgctgagatacgtggctgacaggagtattctgtctcctccccactcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59516 - DNA, 505 bp, Homo sapiens
gggtggtggacgccctgccccctcccacagctctggtccccttcaagggtaaagctgctgagatacgtggctgacaggagtattctgtctcctccccactcaggtcaaccagagctggcgcaaagagccgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 59517 - DNA, 454 bp, Homo sapiens
gtagagatcatatgggtagccagaacttccaccctggtccagtgataacagagactatatgtgaggtttcagtggaggtcagacgccaagtagaaaacctggacttctatctctacctggttagtaaggcagcatcacctgcctcctccgcttacatcccccgacaactttccttgccgtggtggtgtcagagaaagccagctaaaatagaaggttaaaataaggtctagagttttataatataaaaatgtccagtttcaataaagtatcactcaacataccaggaaagaaccaggaaaaactcaagaacaaaaaccttcaaaacaattaaaaagatacaatgaatagatgtcaaactcaagatgacagagatgttaaaattatttggaaaaaatttaaagcagccatagtaaaattattcagtggacaattacaaacacacatgaaataaatg

SEQ ID NO: 59518 - DNA, 763 bp, Homo sapiens
tgggcttcagtggcctataaactctgtaaattccattctaatttttgcacatttattgtgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttctttttttttttgaatagagatcagtctatcacccaggctggagtgcagtggtgacatcatagctcactgtaattctcccatactctaccaatcctcctgcctcagcctccagattggctgtgattgcaggtgtgcaccaccacacccagct

SEQ ID NO: 59519 - DNA, 1743 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggaagcctctcagaagctcatgacgttcgtcagacccttgagacagacggaaactgtttttcactccggaatatgctgtcctctgctgaacgaagcccttgcccgtatgtcctcactgatgaacaggaatccatgttagggaaaacgtggggaggaggctggtgacacacacctcttcccctcccacagcggcccctccacgtgcacttgctcgcttctgcttctctggctggggatgaaagaagggggctgaggtccttgcggggtgaccctggcatcctcacaggccctctcgggctgtcacgttacttctgtgtcaagcgtggtggctgaaccaaatgttctctgagggttctgggagtcctgaaatatgtgcttaagaaattggagcaaaaggccaggcgccgtggctcatgcctgtaatcccagcactttgggaggctgaggcgggtggatcacctgaggtcagaagttcaagaccagcctggtcgatgtggtgaaaccccatctctatgaaaaatacaaaattagccgggtgtggtggcaggtgcctgtagtctcagctactcgggaggctgagactggagaatagcttgaacccgggaggcagaggctgcagtgagccaaggtcatgccactgcactccagcctgggtaagacagagtgagactctgtctcaaaaaa

SEQ ID NO: 59520 - DNA, 882 bp, Homo sapiens
acctttctgtgattggcacttcaaggagctgtgccccatgtggcgctcctcaccacccgccccggaatagccctgccccctgaggctcctctactttccttccctcctcccagaggcctcacaccctactcccctgcctcccccacctcccccgccctctgacccagccacccaggcccctgagccacatcctccacaggaagcctctcagaagctcatgacgttcgtcagacccttgagacagacggaaactgtttttcactccggaatatgctgtcctctgctgaacgaagcccttgcccgtatgtcctcactgatgaacaggaatccatgttagggaaaacgtggggaggaggctggtgacacacacctcttcccctcccacagcggcccctccacgtgcacttgctcgcttctgcttctctggctggggatgaaagaagggggctgaggtccttgcggggtgaccctggcatcctcacaggccctctcgggctgtcacgttacttctgtgtcaagcgtggtggctgaaccaaatgttctctgagggttctgggagtcctgaaatatgtgcttaagaaattggagcaaaaggccaggcgccgtggctcatgcctgtaatcccagcactttgggaggctgaggcgggtggatcacctgaggtcagaagttcaagaccagcctggtcgatgtggtgaaaccccatctctatgaaaaatacaaaattagccgggtgtggtggcaggtgcctgtagtctcagctactcgggaggctgagactggagaatagcttgaacccgggaggcagaggctgcagtgagccaaggtcatgccactgcactccagcctgggtaagacagagtgagactctgtctcaaaaaa

SEQ ID NO: 59521 - DNA, 6448 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59522 - DNA, 5820 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccattta

SEQ ID NO: 59523 - DNA, 6395 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59524 - DNA, 6394 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttatcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59525 - DNA, 6394 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59526 - DNA, 5602 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctcatcctgggaggggtcctcagacac

SEQ ID NO: 59527 - DNA, 5808 bp, Homo sapiens
cgcctgcccattcggcccggcagtgtgtgaggcgcctttcaaaccggagggattggcaagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59528 - DNA, 5896 bp, Homo sapiens
tgccgcctttacccttctcccccctccgccgcccccacgcggcgctcccccggggaggggggaggacggggagcgggggagatagagagacagaaggcgctgtgttgggaaggaccaatcctactccaccgggtggggcggccaacagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59529 - DNA, 5845 bp, Homo sapiens
  misc_feature (92)..(92): n is a, c, g, or t
  misc_feature (94)..(94): n is a, c, g, or t
cgaaacgacggaaacccgcactcgcgtcctctaacgcaaatgaccatctttggcaacgtgcgccaatggaacagaccaagggcgctgggccngngggaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59530 - DNA, 5241 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattgtgtatactttccgcgtgcctgt

SEQ ID NO: 59531 - DNA, 4636 bp, Homo sapiens
ctataccaccctataccactgagctataccaccagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59532 - DNA, 4765 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactgtcctgctccgggtcctttgatggccccagcccagcacactcaatctagccctgtaacagc

SEQ ID NO: 59533 - DNA, 4389 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccattta

SEQ ID NO: 59534 - DNA, 3163 bp, Homo sapiens
  misc_feature (27)..(27): n is a, c, g, or t
tctagaggatcccgacacctctagggngccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59535 - DNA, 2529 bp, Homo sapiens
tctgcattgagaatagtaaacactttgaaatgatcaataagaaaaaaacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59536 - DNA, 2102 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctgga

SEQ ID NO: 59537 - DNA, 2396 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggcacagttggttccaccctatacagccgaacatccacaagatctctaata

SEQ ID NO: 59538 - DNA, 2101 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggaagaggacagcccctcgtcctcgtcggcggggctggacaaggcccagcgctctgtcatcaagcccatcagcattgctgggggcttctacggtgaggaggccctgcacacccccatcgtggtgacctccacacctgctgtcactccgggcacctcgtatccgtccttccagcca

SEQ ID NO: 59539 - DNA, 1918 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcctggctagacccaggactacctcgtactacctaagcggggacttacttctgg

SEQ ID NO: 59540 - DNA, 1820 bp, Homo sapiens
ggagctcggtaccccctaaatggaatccctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59541 - DNA, 822 bp, Homo sapiens
aaaagaactgagcggaccggatgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59542 - DNA, 374 bp, Homo sapiens
ccgggcctggcctctgtccctggacacatggccctcccaagacctggcgtgatcaagaccattggcaccaccgtgggccgcaggaggagagatgagcaggtacagctcagaccagtgggaaggagccacgtcagtggctttcagagccccagaaacacagaacgggtttctgcagactgggagggttaatgttctgagagcaggggagacaagggagctaggggtcgaagagcacgtcatcccccttactggaggccgagctggagagccaagactcaggctggctctgtcatctcgcttatgtcccttagaatctctgagtctcactttcctcagccacaaaatggggatcatggtccctgcaagccaggact

SEQ ID NO: 59543 - DNA, 2382 bp, Homo sapiens
tataagcggagcactggccatccacacataacgtctgaactggaaaagccttggcttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaaaaaaaaa

SEQ ID NO: 59544 - DNA, 2205 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaaaaagacatggaaaaaacttaactgcatgtctgtaagtgagggaatcctagtgtaaactgtggaatccaggtgataatgataagtcagtgcaggttcattgatggaaagaaatgcaccactctggttggagctgttgacagtggaggaccctatgcacgtgtgtgggcagggagtatctgggatcactctgtactttctgcttaattttgctgtgaacctaaaaccactctaaaaaataaaggctattttta

SEQ ID NO: 59545 - DNA, 1385 bp, Homo sapiens
cgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggtgaggaactctgcgtagggtgggagcacctctgggtgggctggagtgagagccccgggggtcctgatcctctctcccacagctgtctccttacccacaaatgccctacagatgagtcagtggagatagagctttccttcctttggacacatgggtcagcattgtgttgattgaaaagagagagagagagggaggtggcgtttagcaccagccagggcccagagggaagaaatgaacaaccttctgtgggggtgctagccacggtttttacgcagcacctgagtgttctctgctcacagaactgtgggggctcctgggtgaggga

SEQ ID NO: 59546 - DNA, 1239 bp, Homo sapiens
  misc_feature (21)..(21): n is a, c, g, or t
aaaggcccaggcggtaccggnccgagttgttaggatttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttta

SEQ ID NO: 59547 - DNA, 1922 bp, Homo sapiens
gttgaatcttttgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttta

SEQ ID NO: 59548 - DNA, 1198 bp, Homo sapiens
gctagtaggattctcaggaaaagcaaagattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttta

SEQ ID NO: 59549 - DNA, 249 bp, Homo sapiens
gttatgatgaggtaataaggactgttcttgttacagataattttgttgcttttgcacttcgctgcagtgcctgttatgcctgctattggtaatacaaaaattattttggaaacacataaaaacatagaaataggtcaggcacggtggcttatgcctgtaatcccaacactttgggaagctgaggcaggaggatcgcttgagcccttgagcccagtcagggtaacacagggagacctcgtctctaccaaa

SEQ ID NO: 59550 - DNA, 291 bp, Homo sapiens
ggtccggagggtactttctaacttgagttattctcattattccactcaagagaagtaactgcaaaacaggtgttaaaccatgcagtaggatttacagaggttgagggactccatgagtccacttgaaccagagcagcacgatttttattttttaggtaggaatttcttttggggggaaaataaggagccaagaattctattaatgctttaaaaatgttttaagtgggaggagggtgaagggacaagcaactctactttctgctcaatattgctgtgaactaaaatttttct

SEQ ID NO: 59551 - DNA, 292 bp, Homo sapiens
ctggccgaggtttagttttatatttattgagtacttgaatttggggcttaaattttaaacttattttctcaagctaactttttctaggaagaaaggttctgcaggctggaaaagtagggggaagataagagaaagaaaaaaaaataagatgggatgtaccaatgaagaaaaatacgatgagagggtctatgaaaagtccagtttgtgaaagatagaaagtatatgaaaagaataagcaaatagattgataccatttaaaaacatttctgcagaaacttgcaaaaaaaaaaaa

SEQ ID NO: 59552 - DNA, 1293 bp, Homo sapiens
atgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtggaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggtggctcagaacgaagtcaacctcagggaattcaaatgggggagaggagggcagtgaatatgctgagaggagttaatcattcagaccttatcagcagcagagtcattagcccttaggggaaatcagatgattcaaaatataaatgcaggccgggcccggtggctcc

SEQ ID NO: 59553 - DNA, 314 bp, Homo sapiens
gaagaagagaaacaagttgcagcaaaagtcacagtggggtagctgtccctagagttgaacagacacatttcaagccttatccaagtttaggacttttggaaagcattgcagttgcgaataagagaatgtgcttggaatcttactcttgtgcattgaagaaggataagaaacaggaagaagtagaagaataaggggctggagatcaagacctacccattgtgatgaataaatccaggctctcagcaatgcagggagaaaaagttttgtctatcaacactgcagcaaccagtctcttagcacaggcaccagccctg

SEQ ID NO: 59554 - DNA, 4345 bp, Homo sapiens
  misc_feature (2046)..(2046): n is a, c, g, or t
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtngcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcaccagcagccggattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgttggttaatgtgggtttatgggttttctttctttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 59555 - DNA, 4487 bp, Homo sapiens
  misc_feature (2046)..(2046): n is a, c, g, or t
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtngcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcaccagcagccggattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgttggttaatgtgggtttatgggttttctttctttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtcaaaaaaaactaaataaaaaagtattaaggtcgaagattcaaaaaattttgcatacataatttacacgaaagcaactgctagtcacctcccctgtgtggacttgggagaggactgggccattcactagagagaattcggcgtgc

SEQ ID NO: 59556 - DNA, 1263 bp, Homo sapiens
tctcagctgcctctgtattggcgtgggttcgattggtctcctatctgaactccgcctgtgcacttagctggaatacactgcgcatttggagcatagactcattcctgccctgtatccggctgcaatgacgactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgttggttaatgtgggtttatgggttttctttctttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 59557 - DNA, 628 bp, Homo sapiens
  misc_feature (11)..(11): n is a, c, g, or t
ctctctagggngctgagagatctggggctttggcctccaaaggcaggagctgctgtccccagagctgaaaacaccaagtgcctatttgagggtgtctgtctggagacttagagtttgtcatgtgtgtgtgtgtgttggttaatgtgggtttatgggttttctttctttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 59558 - DNA, 465 bp, Homo sapiens
gacattcccctgactcccatcttcacggacaccgtgatattccggattgctccgtggatcatgacccccaacatcctgcctcccgtgtcggtgtttgtgtgctggtaaggggtgaccccagcctggagaggcagcgtggcagagtggccaagggccgagtcagatggacatgagtctagttcctggccccgtcacttaccactgtgttaccttgagcaactctcttggcctctctgaaatgcccacatcgtagagtcactgtgagaattaaatgagatgaagcaggcaaagcatttatccaaggcccagcacacagggtatgctctaaaaataatagctgccattctgttctcttgcttaaccctctaccaggcagttagcaacctcctatgcagtggaaatgcagctcatctgactcattcattaaacagacttttattgaccacctattatgagctaggtcca

SEQ ID NO: 59559 - DNA, 564 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacaggtgagccggcccaccgtgatgcccgggccgagatctcgagcccagaaatcctgagacgcgctcagactcggggacgtggacagcctttgtccagcccgagttgtccctcatcccgagcccccgagcccagaaatcctaagaatctcatccagaaacctgacaacccccgaaccttgtgtccaccttccagaaaccctgagactctcccagaccccctaacacagcctcagccccagctccctcacagaccctccctttcacccgtaaccctccgtctggccctctccagttctcctcccgggggacctcacaccccttcagcttccctgccgtcctctcccctttcacttcccctccgcacctcacttcccctcggacccacctcaacccagcccctctcctgcttcc

SEQ ID NO: 59560 - DNA, 393 bp, Homo sapiens
tcgggctttgacctcccaaagtgctggaagcaggagtctcctcttgaagcccctcatcccacctaccccagggctctccctaaccctctctcatctctccccacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtaccacggcgggaagtccagcctctgcgggcccgggaccatgccaggatagaggcagggtggaccagccctgtcccatagaaactgcacgtgggccatgtgt

SEQ ID NO: 59561 - DNA, 269 bp, Homo sapiens
cccaggggtgcccttggccctgatacagatttagctaccttcccccgaaagcctcaaagttctgcaaactcacagccaagcaaaacgcagctgcagtcgagccagcctcgaaaggtcttacaactttctgcagtggccagcttgttctctgtttccatgccttccagaatgaagaagatcagttctaaggtttcttactatttctaccaagagacgaccatcggcattccacagacggctcctctagctgtgcacaatgcctgttctta

SEQ ID NO: 59562 - DNA, 198 bp, Homo sapiens
gttggcaattttgtaaagcaaatgaagggaggatgaaagcaaaggaatttaaagaaagcatatgctattttctacctgcttttgaaaagtcaagtttcagttgtcctcaaccagagtttctagttctttccattgacgtttccagatgagtacaacaaagctcaatattggtttgggaagaatctatccctaacagag

SEQ ID NO: 59563 - DNA, 2259 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59564 - DNA, 2722 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatgtagtatgatcggttgggcttcctcctgaatctggactctaaactagattttgaagtcactgagcgaggacgcagcctttgcattaggatttttaaagctgcccagtaccattcagctcatgctggatacatcatttcatgaggctgcgctatccttcctgagacctgggagtatctcaaagatgggactgctttgttggtcatgaacacacaccagtgtcagagagtgcagggaaagtgtaaatggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59565 - DNA, 2304 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59566 - DNA, 2291 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggcccaggctctgagtgggcctgctctctgtagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59567 - DNA, 2433 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccgagctaagagaaatggtgcatggagacaaaaacatatccaggcatatgtgctccgccagaggtgaagacagaggattgtggggacacagagaaggcccttcagctggaggagtgatgagagattgactggggagacgtcctggtgaagtctgatgcctgaactatgctgggaaaggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59568 - DNA, 2324 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagaggtttccacagtcacggagtattggagagtggtgacgaagaaggcaccgagccctggaaggggcagtaaaggtttgagcaaaggcccaactgatcacttcatctctcctttcagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59569 - DNA, 1618 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59570 - DNA, 1858 bp, Homo sapiens
  misc_feature (1679)..(1679): n is a, c, g, or t
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtcccttnctttatttttaattactcttatctctattttatatatttttatctatttttttacattaaatttcaaataacttatttattttttattatcttctataattaatatattatattttattttttatcattttctttctaattttttaatatattattttttattattttatatattattc

SEQ ID NO: 59571 - DNA, 237 bp, Homo sapiens
aagtctgtgggaacaaggtccttccgccagcactgaggagggaggttgggaagcttaacggttttcctgggacgaggaaaggggtatgaaggttcttttttccctgtcttgggaagggaggaggatgagctgtggcactcctagagcagggtcatcattaccgtgtagacacaactgattaccagtatctgccttcaggtttccacagtcacggagtattggagagtggtgacgaag

SEQ ID NO: 59572 - DNA, 566 bp, Homo sapiens
ctggaggagtgatgagagattgactggggagacgtcctggtgaagtctgatgcctgaactatgctgggaaaggtggggcttcggcagcaagaccagacacactggtgggggcagcttcctcctttgcagaccagttccaggctccagcctaagagcaggaactgtagggatgcttagaagcacagtccctggtgagagcaggcaggctggctgcattcctgtggtatttgaggattgatcttgtcagattagcagctttgctttttttggttcaggtacaagatccccacgtggggagttcttgctgcttgtgaagagcaaaagctggtgaaagcacagaacatgatcctggccctcctcctgagctgtgtgaggctcccagccaggagcaagcagccctgtgagttcctcagtgagagggagggcccaggtctgagctccacccacacaagtcccagcgatgaggcagcagctcagcagagagcaagatgctggcaccttcaggactgtgtcctgctttccctactctgtctgcacctggggagacaggtcactctctgactggt

SEQ ID NO: 59573 - DNA, 319 bp, Homo sapiens
gttgggttctgcctttagcctggaccaaagggaagtgaggcccaaggagcttacccaagctgtggcagccgtcccaggccacccccatggaagcaataaagctcttccctgagcctggcctctttttgccttctctgactttcctggaagaaacaggaacctaaagccttagcaactatgccaaaccctcgggccctctctccagtccacagagtcctgggtccctttcacttcttgtgtcaatgcaggacctaggtagccatccagaggcctctggagcatctcctgtatcctctttgctttgagaccagaggtttca

SEQ ID NO: 59574 - DNA, 2211 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59575 - DNA, 2569 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgaaaaaaaaaaaaaatcaatcacaacccaccctccacccactcccactatacctcctcctaccactctcaccccatcccttcactcggaaataccacccccatcatcctctcacaaaaccatgtcgcccgcttgggcccagccgtctttagaccctcgcagctttaccattgcgcccccaacttcggcctcatttgccaaattcccccttatgggggccgcttcccaatcaaccggcccgcgtttaaccaacgcccgaatggggaacaccctgggggttacccaccttaaccccttgggccctttttccccg

SEQ ID NO: 59576 - DNA, 2263 bp, Homo sapiens
ccataggcgcgtaagcgtggagctacacttactccagtgggacgaggactccaattcagtggttctttcctttgactccgctggacaaacactaggctcaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatgtagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59577 - DNA, 2319 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccgatttgaggattaagccattctgttcttgtctaagcagtgcacataaaaacagcgactgaggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59578 - DNA, 1603 bp, Homo sapiens
acagcatcccacatcctgtgcctgcccgacgactcccttcgtatcctcctctgttacacactggagccccaccacacgctctcttcaccatcattccccttgtccctgtcacacactccatttccccaaacacagatgggcttcctacaccacaggccctgggttccccattaaacgcctcatgctcccgcctcactgtccctacttggggtccctgccactcccctaggctcatcccttgctgtgtgcctcgttgaggcccgcttttgctgtgtccacagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatgcataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 59579 - DNA, 1558 bp, Homo sapiens
cagcggctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgctctttcccaagcaaggccaagtacaggcagtgtcaagtaggtagcaagcaagagagaagacagaagtcaggtccagaaattcaggacctttctctttcacccagactagagtgcagtggctcgatcacggctcactgcagcctagaattcctgaactcgagtgattcttccacctcagccccccgagtggctgggaccacagcctcatgcccagctaattattctatttcttgtaaagacattgtctcactatattgcccaggctggtattgaattcctgggctcaagtaatcctctcacctcagcctgccaaagtgctgggattacaggcatgagccagccaccgcacctggcccaaaattcttagaagatatcattttgataactgtgacattcttttacataaatgtatcatttaatgaaacctctgttgtaaacttttggatttttttctgttttttcactttgtaagtaatactgtaataaagagctttttacaaaggtcttcattttgattatttttagaaggaaaattttgaggtcataagatataaacagctttgaggtctttgacacatagattgttttttagaagggctgtgccaaatttactcctatagcagtccaggagaattttccctcagcagactaccactagcaccaagata

SEQ ID NO: 59580 - DNA, 708 bp, Homo sapiens
gtgtgtcactgaacaccttccccgtaccagcagctggaggatttgtttggtagcacctgggggatggctctgtcccgggcgcacttaggcgggctgtgcggagcgctttaccttccacagtgtccggcacacgcatccttttcgacatcatcacttgacctgctgcaatagacaagtcttgctgtgttgcccaggccggagtgcagtggtgcaatctctgctcagtgcaacctctgcctcctgggttcaagtgatcattctgcctcaggctcctgactaattgggattacaggcatgcaccaccacaccagctaatgtttgtattttcagtggagacggggttttaccatgttggccaggctggtctcaaactcctgacctcaggtgattcgcctgcctcggcctcccaaagtgctgggtttacaggcgtgagccaccgcccggcctcatgtcatcaaaagaagagaaaacagaggcacaagagaagatgaccacagaagacagaggcagaggctggggttatgctaccacaaaccggagaatgccaaggattgctggcaaccaccaggagcctggggagaggcgtggaacccctcctccctcagaggccccagaaggatccaaccctgctaataccttgattttagacttcccacccccagaactgtgagaaaataaatttctagctgctttaagccaaaaagtgtg

SEQ ID NO: 59581 - DNA, 576 bp, Homo sapiens
tattttctagataacatgccttttgacctgaaaaagggtttagtataataccttaaaaattctcatatatagtagccattttaaatgaaacaaaaagatttagaagcctggtgttgcttgatgataagattaagaagtttaaaacgggtttatcattactatagcacactgtaaagtgctagaaaagtcataacctgattctccaatctttttattcctctatgtggaaatttagctacttgtaataaggtacattttcagtaaggatctggtgagatcatattatgatctaacatgaaagccaccgcccggcctcatgtcatcaaaagaagagaaaacagaggcacaagagaagatgaccacagaagacagaggcagaggctggggttatgctaccacaaaccggagaatgccaaggattgctggcaaccaccaggagcctggggagaggcgtggaacccctcctccctcagaggccccagaaggatccaaccctgctaataccttgattttagacttcccacccccagaactgtgagaaaataaatttctagctgctttaagccaaaaagtgtg

SEQ ID NO: 59582 - DNA, 527 bp, Homo sapiens
gtgtgtcactgaacaccttccccgtaccagcagctggaggatttgtttggtagcacctgggggatggctctgtcccgggcgcacttaggcgggctgtgcggagcgctttaccttccacagtgtccggcacacgcatccttttcgacatcatcacttgacctgctgcaatagacaagtcttgctgtgttgcccaggccggagtgcagtggtgcaatctctgctcagtgcaacctctgcctcctgggttcaagtgatcattccggcctcatgtcatcaaaagaagagaaaacagaggcacaagagaagatgaccacagaagacagaggcagaggctggggttatgctaccacaaaccggagaatgccaaggattgctggcaaccaccaggagcctggggagaggcgtggaacccctcctccctcagaggccccagaaggatccaaccctgctaataccttgattttagacttcccacccccagaactgtgagaaaataaatttctagctgctttaagccaaaaagtgtg

SEQ ID NO: 59583 - DNA, 873 bp, Homo sapiens
gtgtgtcactgaacaccttccccgtaccagcagctggaggatttgtttggtagcacctgggggatggctctgtcccgggcgcacttaggcgggctgtgcggagcgctttaccttccacagtgtccggcacacgcatccttttcgacatcatcacttgacctgctgcaataggtaacctacctggctctctcgcatcccgttatcagcgtcaagaagatttgcacgtaggcctttaaagccagccaccagccccgggcgccttcctctcactaaccccatgctgcctttccaaacggaagatgaacttagcaattctaggcgctgcctgtgtactagacaagtcttgctgtgttgcccaggccggagtgcagtggtgcaatctctgctcagtgcaacctctgcctcctgggttcaagtgatcattctgcctcaggctcctgactaattgggattacaggcatgcaccaccacaccagctaatgtttgtattttcagtggagacggggttttaccatgttggccaggctggtctcaaactcctgacctcaggtgattcgcctgcctcggcctcccaaagtgctgggtttacaggcgtgagccaccgcccggcctcatgtcatcaaaagaagagaaaacagaggcacaagagaagatgaccacagaagacagaggcagaggctggggttatgctaccacaaaccggagaatgccaaggattgctggcaaccaccaggagcctggggagaggcgtggaacccctcctccctcagaggccccagaaggatccaaccctgctaataccttgattttagacttcccacccccagaactgtgagaaaataaatttctagctgctttaagccaaaaagtgtg

SEQ ID NO: 59584 - DNA, 3048 bp, Homo sapiens
  misc_feature (3048)..(3048): n is a, c, g, or t
cgccggcggggaagatgaccgcgggcgccggcgtgctccttctgctgctctcgctctccggcgcgctccgggcccataatgaggatcttacaactagagagacctgcaaggctgggttctctgaagatgattacacggcattaatctcccaaaatattctagaaggggaaaagctacttcaagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaan

SEQ ID NO: 59585 - DNA, 335 bp, Homo sapiens
cttcaatgtgcctaagtttcttatatggattctaattttcccctcaggttaagtagtattttgagctatttatacctctttagtctcctgagaaagttctggttggacccagtgtgtaaaagaatgttggactcgaatttttttcttgtgttgggatgttggctggagttgaaagataaaaataatatgtgccccttatccccttatactaaagtaacctcaggataagctgctgaaaatctctgcaggacttgctaagaaaaaacataactctatttctctggtccagttatatatctggaagtttgagttttgataaaaattttttaggtagg

SEQ ID NO: 59586 - DNA, 410 bp, Homo sapiens
tgtataccgaggaaataattgcttttgggggaaatcattcattttagggaactgtaaccagtggagatgaactgagtttttagaattaagaaaaacccactgtattaggctgttcttgcattgctataaagaaataccagagactgggtaattatgaagagaagaggtggaattggctcacgcttctgcagctgtacaggaagcatggtgctggcatctgctcggcttctggtgaagccgcagggagctttcagtcatggcggaaggtgaagggggaacaggcacgccacaatgcaaaaacaggaatgagagagcgagagagtgagcgagcgtgagtagtgttgggagggaggtgccacacacttctaaatgaccagatctcatgagaactcactatcatgaagacagac

SEQ ID NO: 59587 - DNA, 243 bp, Homo sapiens
agatctttcaggtgatggaatagttctgtatcttgattttggtgaatctacacatgtgatgaagtaacgtgataaaatgacatagacctgtatgcctactacaatacagtatcaaaaccacggattgattcctggttctttttccaaattccacttttacaaacttatcctaaggtaatattaaaaaggcaccaaagagccctagatccctggataaacaggatcatttcaaagttgtttata

SEQ ID NO: 59588 - DNA, 2082 bp, Homo sapiens
aatgccttgcgcgccgcgggcccagagacgtgaggctgtcggcgtcctggtggccccgcctcgtgtccccccccggaccccacgccgcgggagcttgggggctgcggtcttctcttcctccgacctcaccttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaatttttttttactatgtatctttgtccttacgtatataaattttatgtacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggcgctcacgagagagcctttatgggatttttaaaaaatggggattgtgggaaaatggctccagcagtcacagtttttcagtttctcacaatcccataaaaacagagcaaccaggtaacaaaactaaagcatgggcaacatttacagaccactggatggtgaagaattcccatgaacccctggttcacaccgtaaggacacactactcagcatgggcaacatttacagactactggatggtgaagaattcccatgaacccctggttcacactgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaaatttaaaaaaaaaa

SEQ ID NO: 59589 - DNA, 437 bp, Homo sapiens
  misc_feature (2)..(3): n is a, c, g, or t
  misc_feature (109)..(109): n is a, c, g, or t
cnncatgaactcctggttccaactgtaaggacacactaccaggggtttcttttttgggttaaaagggcccccttggaaaaggccgcggcccccccctttcccccccccntttaacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaaatttaaaaaaaaaa

SEQ ID NO: 59590 - DNA, 1982 bp, Homo sapiens
gcaggctggtacggtcggagtcttggatacttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaatttttttttactatgtatctttgtccttacgtatataaattttatgtacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggcgctcacgagagagcctttatgggatttttaaaaaatggggattgtgggaaaatggctccagcagtcacagtttttcagtttctcacaatcccataaaaacagagcaaccaggtaacaaaactaaagcatgggcaacatttacagaccactggatggtgaagaattcccatgaacccctggttcacaccgtaaggacacactactcagcatgggcaacatttacagactactggatggtgaagaattcccatgaacccctggttcacactgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaaatttaaaaaaaaaa

SEQ ID NO: 59591 - DNA, 2084 bp, Homo sapiens
aatgccttgcgcgccgcgggcccagagacgtgaggctgtcggcgtcctggtggccccgcctcgtgtccccccccggaccccacgccgcgggagcttgggggctgcggtcttctcttcctccgacctcaccttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaatttttttttactatgtatctttgtccttacgtatataaattttatgtacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggcgctcacgagagagcctttatgggatttttaaaaaatggggattgtgggaaaatggctccagcagtcacagtttttcagtttctcacaatcccataaaaacagagcaaccaggtaacaaaactaaagcatgggcaacatttacagaccactggatggtgaagaattcccatgaacccctggttcacaccgtaaggacacactactcagcatgggcaacatttacagactactggatggtgaagaattcccatgaacccctggttcacactgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctttttcactgggtagccatcgatacatcactcttctaagactatgcgcatgtccag

SEQ ID NO: 59592 - DNA, 2021 bp, Homo sapiens
aatgccttgcgcgccgcgggcccagagacgtgaggctgtcggcgtcctggtggccccgcctcgtgtccccccccggaccccacgccgcgggagcttgggggctgcggtcttctcttcctccgacctcaccttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaatttttttttactatgtatctttgtccttacgtatataaattttatgtacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggcgctcacgagagagcctttatgggatttttaaaaaatggggattgtgggaaaatggctccagcagtcacagtttttcagtttctcacaatcccataaaaacagagcaaccaggtaacaaaatcacaccgtaaggacacactactcagcatgggcaacatttacagactactggatggtgaagaattcccatgaacccctggttcacactgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaaatttaaaaaaaaaa

SEQ ID NO: 59593 - DNA, 1995 bp, Homo sapiens
aatgccttgcgcgccgcgggcccagagacgtgaggctgtcggcgtcctggtggccccgcctcgtgtccccccccggaccccacgccgcgggagcttgggggctgcggtcttctcttcctccgacctcaccttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaatttttttttactatgtatctttgtccttacgtatataaattttatgtacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggcgctcacgagagagcctttatgggatttttaaaaaatggggattgtgggaaaatggctccagcagtcacagtttttcagtttctcacaatcccataaaaacagagcaaccaggtaacaaaactaaagcatgggcaacatttacagaccactggatggtgaagaattcccatgaacccctggttgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaaatttaaaaaaaaaa

SEQ ID NO: 59594 - DNA, 1911 bp, Homo sapiens
  misc_feature (7)..(7): n is a, c, g, or t
ggccgcntcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 59595 - DNA, 1834 bp, Homo sapiens
ggcggccggcggggcgggcggggcctgcgcggggtgcccggccttcccgctaagcggtccgccccgcagctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagtgagtcccggtggagaagccgctcatcagccctcccccagtgcaatccccccgcctccacgtcccacctgtgaggatgtgatggggtctgggtgctgagccacgccctatgcacagcccctggtgggaacctgcctgggtgcccaggtaccttggtctgcccttgaagggctgcagagagcaagggggccaggtccggtggccccatctttaggtgccacccaggctcttggctgtgcccatgcttgggagggtggggcacagtggccacctttcctctgcccccaggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 59596 - DNA, 1369 bp, Homo sapiens
ctagctcgaaagccacgtgggacaggcaagggggtgcgagaaagtcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 59597 - DNA, 1738 bp, Homo sapiens
  misc_feature (7)..(7): n is a, c, g, or t
ggccgcntcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacctgtgagttgggggctccgggtagggcctgtgtggacccgtgagttgggggctccgggtagggcctgtgtggaccctgtgggccctgtgcaggtggccaggctcagagtcctagatccccatccctgggatgcaggtcaggtgaggaggatgggaggtcagggcagcatggggccgtgtggcctggtggagatgacctctggctggagctggaagttgaagggaagggtgttcctggcaggctcagcacagaggctggcacagaaggagccgggagtggtgaaaggcagctgtgagtcagggaaccagggcccacttagcccctcctggccccca

SEQ ID NO: 59598 - DNA, 2003 bp, Homo sapiens
  misc_feature (7)..(7): n is a, c, g, or t
ggccgcntcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctcccaaaaaaaaacctatataagacataataaacaaacacacaagcaaacaaaaaaaaaaacacaacgaagggacagcaatcaataaaaacacagg

SEQ ID NO: 59599 - DNA, 1404 bp, Homo sapiens
ggcggccggcggggcgggcggggcctgcgcggggtgcccggccttcccgctaagcggtccgccccgcagctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttgacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 59600 - DNA, 1839 bp, Homo sapiens
  misc_feature (7)..(7): n is a, c, g, or t
ggccgcntcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 59601 - DNA, 379 bp, Homo sapiens
gtgtgggaaagctggctgattgtttttttttttttttctggaaagagtatcaagtagataaaacttttgtccattctggacagtgagaaaactgaggctcagaggagttaggtgactatcctaagatcacacagcttccaggcaccaggcattgacgtcccccagttaacaaatgttatgctctttcttctctcttgctttgcctttgaagaatgaattctctttcacaggggtcacaaactcaatgacctttgaggtcaagcagatcagggtggggctgaggagcacaggacaatagggactgataagaagtgcagggaatattcgaaaagcattaaggttcagccttggcgtttaattctgtgccccctgatgacat

SEQ ID NO: 59602 - DNA, 106 bp, Homo sapiens
cgtgacttttggactctcccctccaaacgccttataggtatagtttggcaatcttgctcacacctgggtgtgaacctgcgtgtacccagcccgggagatattggag

SEQ ID NO: 59603 - DNA, 226 bp, Homo sapiens
ggaaggaatggccttccctcatctcccagaccctggaaccagaccctgggacttccaagatcccacctggactgggctggctggggcagaggagcagggctaggttttgagggaagagtgtggcagtggggtactactgcccaggccaggggtaacgttccagggtgggtggaggtgaggaggaagagagggaaggaagactaccgtcacaagtcaggatgggaag

SEQ ID NO: 59604 - DNA, 179 bp, Homo sapiens
aagttttagggtcttaaaaattattaagaattccaagtagcttttgtttttgtggctctatctctctatacttgccatcttataaattgaaattgagaatcttaacaatatttattgacatgatttaattacttaaaataacaataataaccctactataagtaaacataataaatttt

SEQ ID NO: 59605 - DNA, 204 bp, Homo sapiens
attcctgacctgtgatattggccattagagcctttcaagaatggtacctcctgccgatgattttttttaaagccttaatgaagagagtgtcctctggatccttccagagaagataggatgtgagtgagtaagttatgtataataatttcaccccaaaatttctatgtccttgataccattccctgtataccaaggaagggtatt

SEQ ID NO: 59606 - DNA, 462 bp, Homo sapiens
agtatagagttcagttataaattgtggtactgtatgaagagatttggaagagctatataaggattaaatccttcacctcaaatatagtgatatagagaagctaaaaaataagatacatgtcttataattttgccttgtctcagttctgtgtcttccccttttgacacaacctaaaaccaaattgccaagaaaaggaaacaactaccaaaaagcacagctggtgcgttagtgggactgaattcacggcaccagtcactcatgaatttgtgtagacacaggtggatctgaaggacttctcttcaaggcacatgcagtttagccaggcactgaccagctccaaattctccttgaccacttgctacctgaatactcaaggcccacttgctgctcaatccaaaattcactcaggccactagactgttctactaccttaacatgttaagtttggaaagctgttttcct

SEQ ID NO: 59607 - DNA, 1073 bp, Homo sapiens
ttgaggctgcaatgagctataattacaccactgcactccagcctgggtgacagaatgagtctttgtgccaaataaataaataatcattcatttaacagatattcaccatatactatttgccaggtactgttctaggtgctggttatgcagcagtgaataaaacagaaaaatctgtaccctcatggaacttacaatcttgtggaaagagagagaataaataagacatatggtatgttagacaggcaagctggttaatttttatgcctcagtttgttcaattatactaaaggtacttgaaacaatatctctaaggaccttcctagctctaaaatcccatgattctgtggtgttttaactttctcatttttttctactgtgctgacctcatccattgagtaaatatttacacacctaccatgtgtttataactgctatgcatgtgagagaatcaaaaagtagagcacaaagtttctgcctttgaattgtttatagtcggtctggaaacaagaggtatctgtatattaacactgttatttccagtgtgttcttattctgtccagaacagatccatattcttcaagggaatagcagctacttcagctgcaacctaatttctgggtgagggacagggttgcccctgaacacagtataatactccttttttttaatgttcttatatatgtaggaatcctcactgtagttctgtagcattattttatgttgtccacttattttcggtctggaacttagccaggataggaaaatttatctcagaatttagtagattggttttcattgggatttaatggatgatcactctctgccctccttatcttttgtgtgcctatatatgtctgtgtgtagtatccctcactgtctgctggggaccagttccaggaccacctgtggattccaaaatccactcaagccccacagttgcctgttgagaacttgtggatacaaaaagctggcctatttttgcagctttcgtgtcccacaataccatatttttgatccaagttggttgcagatgcaaaattgcccatactgagggctgacatatttattgcaaa

SEQ ID NO: 59608 - DNA, 561 bp, Homo sapiens
ttgaggctgcaatgagctataattacaccactgcactccagcctgggtgacagaatgagtctttgtgccaaataaataaataatcattcatttaacagatattcaccatatactatttgccaggtactgttctaggtgctggttatgcagcagtgaataaaacagaaaaatctgtaccctcatggaacttacaatcttgtggaaagagagagaataaataagacatatggtatgttagacaggataggaaaatttatctcagaatttagtagattggttttcattgggatttaatggatgatcactctctgccctccttatcttttgtgtgcctatatatgtctgtgtgtagtatccctcactgtctgctggggaccagttccaggaccacctgtggattccaaaatccactcaagccccacagttgcctgttgagaacttgtggatacaaaaagctggcctatttttgcagctttcgtgtcccacaataccatatttttgatccaagttggttgcagatgcaaaattgcccatactgagggctgacatatttattgcaaa

SEQ ID NO: 59609 - DNA, 269 bp, Homo sapiens
ttcttataaagattaggaaccactgagcccaactgtcaataattgtaactttttgcctgtttgccatataaccctttgagaaccactgtctctatccattcctggtgttctagagttgtttcattactacctgcaacagcagcttattcaatctttagtagtcacaagcattcaccaagcaatctaggtaagtttatctctataggaggaaaacacctttcctttaaatacgtcacaaattatatatatttattaaaatatgagagcaa

SEQ ID NO: 59610 - DNA, 359 bp, Homo sapiens
attcaggacataggcatgggcaaggacttcatgactaaaacaccaaaagcaatggcaacaaaagccgaaattgacaaatgggatctaattcaactaaagagcttctgcacattaaaagaaattaccatcagagtgaacaggcaaactacagaaaatctacccatctgacaaagggctaatatccagaatgctacctaatttttaaagactttttccggcatcttgaaaaaaaccaccattatttgacataggtaaaactgaaaaaacaaactattcataattacaatttgtgacacattatgtagtagctaggttcatcacataaattacatgataccccagttcaagttaaatttcag

SEQ ID NO: 59611 - DNA, 250 bp, Homo sapiens
gcagcctctaggagctgagggtgccctccagctgacatccagaaagaaattgaagccctaggttgtgaaaccacaaggacgtgaattctgccaacacataatgcaaacataatctattgtgaaagaaattggaccagtggatgctctggggattgagggcaagcattgacttggaaagggaatgggataacttcctgcagtgatggacatgttctgtgtcttgaggtgtaggtcacggaggtatatgcat

SEQ ID NO: 59612 - DNA, 245 bp, Homo sapiens
aaagttttgtgtctggcattactttcctctagtagatatagtctaaactgagagcatttaaacaattaaaaagagtacaatctcagcactttttgaagctgaggcaggcagtagtctcaactactcgggaggctgaggctgaggtgaggctgagtatggatacactgtactaatcaaagctatttcaatttaacctgagcctgggaggtcaaggctgcagtgagttgtgattgtgccactgcact

SEQ ID NO: 59613 - DNA, 258 bp, Homo sapiens
gattgcatgatggtcccaagaaaactccaccagatttttattcataatcatccaccaactgcaacacaccaagtaggaaaaaaaaaaacttactcatctgacagcctaaggagttatattttccctttagagagaatagcatgtttctaggatgaaacacgaagtggtttattaatatgcctaattgatgatgatgcagcacgggcagccctggagactaaggcgaggtgccaacactgagagcatggccccagattt

SEQ ID NO: 59614 - DNA, 954 bp, Homo sapiens
aggtatgaacaggtgtgctctaagtcagagggcggagtggaggggaacctgcatgaagtatctttccttagcaggccaggcacattccctgctgtttttggggagcgggctccaggatcctttccctcttggaaaagagcagaaagtgccaattggatctctggtcactgaataaaactgatctaccctctgagtgtggcccagctcttaacaggagcaaattgagacctcaactgaattctgccttgaagatcttttgtgatgtttactggtccacgaagacaggagagtgagggtaggaaggtgcaaggacagatagttgctgccaaaatgaatttggccaggttcattcatctgctctcccttgcacacagctctctcattccttcctctttgactttttaaaaaataaactttttgttgtagtatagtttcagatgtatgggaaaaatgaggctataatacagagaattcccacatatcctgtatctagtttcccccattattatcttaagttagaatggtatgtttatcacacttaatgagccaatacagttaccttataattagctaaagtctgtgctttattcacctttcctcagttgatacttaatgttctttttcggtccggggatcccatccaggatgcggtgtcacatttagttgtcgtggagccccaggctatttttggttgtgacagtgtcccagactttccttgtttttgatgatcttgacagtttcgaggagtactggtcaggtgttttgtagaatacccctcaattgagatttgtctgttgtttttctgtggcgattcaactggggttgtggattttgagggggaggatgacagaggtaaagtgccattttcatcacatatcagtgtgacttatcacatgctgatccttatcacttggcggaggtagcgtttgccaagtttctgtactgtaaactgaa

SEQ ID NO: 59615 - DNA, 1062 bp, Homo sapiens
tagtggctgctgcctcctgatgaactgtttggggaccccagctctactcaaaagggagcggagataaatggaacccctcacactgctgaggcccgtgttactgttcattcagccaggtggcatgtacctcacagactgttgtgcagtgtccgttattgcagattttaatcatttgcatgctcatcaatttctaagataaatagggtctagagtcataagaatccattgttttcaaggaacttgcagaattacatcatttcctattagtagagagcactacccattttgaaaatctgatatgaaagttgttttttactcttgtaaaaaagactttcttagtcaaactaacttttcatattttcaagcattctgattcatactcttgctagtggaagaagagagcaagctgccctgctcttttcctttgaggactgaaatagttaaagagaaatcaatgaacaaagtcactcccaaccattttcctgtaaagctggttattatttctcaaggaacctacactttgaatatgtgttaccgagatacctctacatgtggaattatcaacatgttttgaatgagagcagaaatgaacagactggaaaaatctatctcttggtttctatttctctgactttttgagtcgaaaagcataaaggtagaaattcttatttaagctgcttctagtggtgcctgagctggttttgatggtggcatcaaactaccgatttaaaactggaagttgctggtactcaaaccaaaagttcatactctggcgacacgaagggtttcctttgagcaacgtcagctgctgagtccttgtgttcagttcccattgaggagagttggcttttatccatttcaaagcatttgtaggccagccaagggctttcattattgaggcttctagtggcctctggttaacctagaagttagtgggtttttcttgatgacaccaacctctcacagcgtttttccttagagacttaagcagagttttaaaatcctcttttgcgaaaagaacaaatatgttttatgactttgatgatatcttcattctgggca

SEQ ID NO: 59616 - DNA, 606 bp, Homo sapiens
tagtggctgctgcctcctgatgaactgtttggggaccccagctctactcaaaagggagcggagataaatggaacccctcacactgctgaggcccgtgttactgttcattcagccaggtggcatgtacctcacagactgttgtgcagtgtccgttattgcagattttaatcatttgcatgctcatcaatttctaagataaatagggtctagagtcataagaatccattgttttcaaggaacttgcagaattacatcatttcctattagtagagagcactacccattttgaaaatctgatatgaaagttgttttttactcttgtaaaaaagactttcttagtcaaactaacttttcatattttcaagcattctgattcatactcttgctagtggaagaagagagcaagctgccctgctcttttcctttgaggactgaaatagttaaagagaaatcaatgaacaaagtcactcccaaccattttcctgtaaagctggttattatttctcaaggaacctacactttgaatatgtgttaccgagatacctctacatgtggaattatcaacatgttttgaatgagagcagaaatgaacagactggaaaaatc

SEQ ID NO: 59617 - DNA, 1450 bp, Homo sapiens
tgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccataaaaaaat

SEQ ID NO: 59618 - DNA, 1424 bp, Homo sapiens
aggaggctgaatacgggatggagggtatggagggaccgggtctgtcccctgtggagagttggagtgtgtgcaggtgatgtagagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccataaaaaaat

SEQ ID NO: 59619 - DNA, 1162 bp, Homo sapiens
tgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccataaaaaaat

SEQ ID NO: 59620 - DNA, 1490 bp, Homo sapiens
aggaggctgaatacgggatggagggtatggagggaccgggtctgtcccctgtggagagttggagtgtgtgcaggtgatgtagagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccataaaaaaat

SEQ ID NO: 59621 - DNA, 202 bp, Homo sapiens
tgggaaactccatcaacccctgcttctcaaatccagacaggccacactggctagaacttccacccagcagtcctgctcctgcccgaagtctgcaagcaagtgcaaccacatgttgctatggaaagcacacagacaacagattagggcagacctggcaaagatatggcctgtctgccatcttcagcccctgtttgagggaggc

SEQ ID NO: 59622 - DNA, 170 bp, Homo sapiens
ctttttttggacacatttgtgtccaaacctactgaatcagaaaccttggggttagggtgtagtaatatgtagtttaacaagccctccaggtgattctgaaacataaagtggagaactcctactatactgaacatactttaggaattcctgttgccttctaaagcactatt

SEQ ID NO: 59623 - DNA, 341 bp, Homo sapiens
tttcagtgccagtgggtgggtgtcctgatgaattagataagacagtgtgtatgccatgcgattctcatttggaaagtgaacatgcttcccatcggtaccttccaattttggagaattaaaagtatttggattaaaaaaagtcagcaatgatcatttagtaaatcagtgtttccattttttactttgagcaaatgaaatatttattacaaattctcattgatttaagagtataaacaatatttaaatgtataaggaagaatgtaaagctgtaagaaaatgtattttcatttatttgaagaaatctctcccaacactggaatagagaagcagaaatctcttat

SEQ ID NO: 59624 - DNA, 369 bp, Homo sapiens
acacatgctatcaattgtttttcttctatctgtagacactaatcttactttctgcctcttccatctcaattgtcatcaacattttgcaaaaaaaggtcttatagtacacacattgttttgtacatagcttttttctcatcgaattttagtccttttatcatgttagtactcattatttcagctcatagtttatatcagccacctagcactccccaaggataatggctatggcatgatttaatcattcccctattgatgaacatttggatagatttaatttttttagctgttacaaataacacttcagtgaatattcttgtacctacacctttgctaatgtgtacaaagtattaccgcaagtggaaacac

SEQ ID NO: 59625 - DNA, 312 bp, Homo sapiens
atttttatgaatacataagaaagagttcagccataaactgtgatgttgacatccatgccaatatccataattactgttaataaaatataaagcacaaaacagatatgacaatataatacttcagttgtgcaggatatgcaacagacacaattcctaagtgctggtatgaggcaattaaatcatgcacttatgcaaaatgttagggaaaaaaattataattacagaattgcttgatgtacttttagtttgtattatgttttgtcagcttattagaaacacaagaaaaacagtcaatgaaaataatactagcag

SEQ ID NO: 59626 - DNA, 307 bp, Homo sapiens
tctaatcccaatctctttccaaatgagctaaggaagcactgttttttttcctgtatagcaaaatgagttcaagatattctttgcctaatttcagctctagctagaaccagtcaatatggaaataaacaatgagggtatctaatctactgaacactgaaccatcagcctaactctatgcaatatagtcatactaaaatatttctcataaaaaagttcttaacagtttgttcactatacaaagacaaaaatctggtagaaaacttaagaaaacatggagctaacatatttattatagcggattgaagtt

SEQ ID NO: 59627 - DNA, 188 bp, Homo sapiens
aaataaaaaataaggtccaagccaatgcctaacagataataagagctcagtaaatgttgattgaatactaacaaagtagtgaaagcagacgacacagtacctggcacactactaaactgtaaatgttttcaaatctgaatctgtagaattctgtaaggttttatgtaatatgatgtcattagctatta

SEQ ID NO: 59628 - DNA, 1152 bp, Homo sapiens
acctattgtttcataaaaggctgctttgtgcttgtatatggccaattctcttgaaaggttagtacattttattgatgtacacatgtaagtattataatatttgaacaactacttagacatcaaagcagtttcagatgttcaagggtttttcttttattcttgggtaaagcaacaagggaaaagggtttaatataaaaattgtataagttgagaatgaggtctgattggttaaaaggttaggggactgtatgaagcacattaaaggttaatgttcagtttaagtttgtgtctgtctgaatctgtcttaaagattgtacaggtaaaaaaatagacatagcaaatgttttactgtttgtacaaagaataattagtctatatttaaaaatggcattatttcatttttcaatgtttgggaaaaagactgcctttatggaaggagaaatgtggaatgtctgtcttcgtttgattattcttatttttaaaccatgtgcagtatcccttacatcaaaaagagatacaaagaaatgttttctattataagagtcatccaacatgaaataaactgcttttgctgagtttgttgctgttgttgttattgctgcagcagctgctgccgttttgtttaatcgcagattccatagagcataaccttctttcaggaatcatttttttagggattcctgtactggatagactactgaacaaaatcatcaaaatctctcctcccctacccagagtcagtgctaatcactagattatagtaaaatgatgaaagaaatttaaaaattatatatgtatatatgcctatatacatgtgcaacattggcagccctttatctctggtagaaccattttttcttctaagttttttggtggattaggtatatgaacctaatcctattttaattatgatagatgctattggtttaatttaatgcctttgcagagcaaaagaacatactgacattatattttcatctgatcctcactgccctctctctgctgtgggggatattttactggtccatgaaatccaagtctgggaaccactgaagtaagtgatctcaatggttatttcataatcattctatgtaaatctacccaattaacagattttgcaacggcttttaattgtatagagccaggacccta

SEQ ID NO: 59629 - DNA, 801 bp, Homo sapiens
cgatcccttcctgcctcagggtcccgggctcagcctcccgtccacgctccctgctcagcttcctttgccttgcagtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59630 - DNA, 1541 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaaaaaaaaaaaaaaaaaaacaaaaaaaaaaaaaaaaaaacaccaaaaacacaaaaaaaaaaaaaaaaaaaaaaaaaaaaaacaaaaaaaaaaaaagggggagcgaacaacacaaccaaaagaggcacagaaaagccacaacaccaaacaacgcacacacaggagaacacaaagaagcacaaaaaagaaaagaagaagacccacagacacacacaacgcacggaaaacaagaaacagaaactaggcggcacaggaaaaagaggagaacacacacgaacacaacccacaaaaaaaaggaagacgagaaaaaaaacaaacaacaacagacggcaacaacgcagaccggagccgagaaaaatgcaaagcaaagagagaacaacaagcaccaagagacagaggagaccacaagagacgagagagagcacagccagaaaacaacaacaagagaagggagaaacaacagggaagcaggaagagacggaagaaacgagaagacggagcacaaacagaaaggacggaggggcaaacgaagacacgaaagcgacaagaaacacacagagccaggagagaaacagaaagaacgagaacgaagaagcagaagaaagaaaaaaaggagcgcgaggaaac

SEQ ID NO: 59631 - DNA, 938 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagtttggacaccgtctctccacagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59632 - DNA, 855 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaaacaacaaaacacaaccaaaaaac

SEQ ID NO: 59633 - DNA, 534 bp, Homo sapiens
accagaactgatagacagctaaaggatattgcaagcatcattattggaattgggagattccacagaacaatctgagaatgatctcatatcaaatccaatcagatgagttattctgagactaattccaatagttctagagacttttttttttatggtggacattgtttttattgtgtaaataagcaatttttaaagtatatttaaagaaatgaaacataaggaagtgtataggctgtcaggtatgtggggaagtgaagttcatgtagttttcatgtggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59634 - DNA, 229 bp, Homo sapiens
tttgaagaaagactaatcgaaccatctagtagctggtgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59635 - DNA, 239 bp, Homo sapiens
attcgaccgcgcatctcggtcgaatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggataacgaagagatctacattcgagcgcgagattcaccgc

SEQ ID NO: 59636 - DNA, 149 bp, Homo sapiens
gccagattttggtaacagagtgatgttggactagtttaaaatccagcgtgcaccccgccggaggaaggtcccatggcctgctgggcttggctcggcgcccccacccctggctaccttgtgggaataaacagacaaattagcctgctgga

SEQ ID NO: 59637 - DNA, 1455 bp, Homo sapiens
ggcgtggggaaccctcaggctccagtgaccttggtggggggcgtctgggggctccccctccccacccccggccgggcacggacgcgggtgaccgtactgcgacgcgctccgcggccctccaggccgttgtaggcgcgcgggctggggtcggggaaggggaaggggttgttccacgcgcgcgggtcgtggtcggggaaggggccgtccaggccgttgcaggcgcgcgtgccggggccggggtcgggggtccaggcttgcagggggcggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59638 - DNA, 708 bp, Homo sapiens
  misc_feature (3)..(3): n is a, c, g, or t
  misc_feature (36)..(36): n is a, c, g, or t
  misc_feature (47)..(47): n is a, c, g, or t
  misc_feature (58)..(58): n is a, c, g, or t
  misc_feature (76)..(76): n is a, c, g, or t
aantgaatctattccgtggagcgcgcacagcgccantcgtcccgggncgggcacatgnttaacctggacaagtacnggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59639 - DNA, 677 bp, Homo sapiens
  misc_feature (37)..(37): n is a, c, g, or t
  misc_feature (61)..(61): n is a, c, g, or t
  misc_feature (64)..(64): n is a, c, g, or t
  misc_feature (76)..(76): n is a, c, g, or t
  misc_feature (80)..(80): n is a, c, g, or t
  misc_feature (96)..(96): n is a, c, g, or t
  misc_feature (111)..(111): n is a, c, g, or t
caccatggttcaaccttgtcacaagtgaccggccccncccccgcccccctccccccacacnctncccctccccacnccangccaaccaccgcacantcccacgagactcgnggctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59640 - DNA, 1580 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaacacacaccacaaaaagggacgaacagaacaaaaagatatcctcgaagtggggcacagcatacccccgataacccacacaacagaggaacacacgtgcaccatacaagcgaacagcaccaacacaccaagaactgagccgaagaaaaaaaacaacaaaaaatgcagaaaataggaacgcacgccgaaaccacacgaaacacgcaccaccaaccaccaggcagaacgcacaacacccggacaaaagcacacacaacagaccaatacacagcccaaacggcacacccacccaccccaacgaagcacacacagcatgcacagccacccacaccacgcacacacccacaaaacacggcaccaagcgcaacaaaacacacacacacaactacacaccagcaacaacacgccacaagacacagaaacaaaacacaaaaaagacaacaagcagaaacaaaaaccgaggaagaagaacaaaagaagagcgcattacacaggccgatccaccgaagacacacaaagcactaaggcaacaaacaacaacaagaaccaccgacccccacacgagaaagaagaacggagaaaggacagacaaaaggggaaacgagaaaacacaacatctctcagcccacttcgcataaagacgcgcagacgaacccgaccagacaa

SEQ ID NO: 59641 - DNA, 938 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccacaaccctgggttgtgggcgcgcctgcagaggatcaagacagcacgtggacctcgcacagcctctcccacaggtaccatgaaggtctccgcggcagccctcgctgtcatcctcattgctactgccctctgcgctcccgcatctgcctccccatattcctcggacaccaaaccctgctgctttgcctacattgcccgcccactgcccgcgcccac

SEQ ID NO: 59642 - DNA, 883 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctgctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59643 - DNA, 977 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagacagcttggggactgtggggggctgctggggacgctcacgtccatgtgcttcttttccagtgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59644 - DNA, 859 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59645 - DNA, 916 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59646 - DNA, 1036 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggtcgggccccacctggtactgtgggataacgacatgaaaaaaaaacaacacaaaaaaaaaggcggcgcccggaagtaactgggggaatagaatggaaggtagaggggaaggggtgacaaaccggggggacaaggtgtgtacgtaccccgaggtgagaaagatgaagtggaaaggcggcac

SEQ ID NO: 59647 - DNA, 620 bp, Homo sapiens
ctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagacagcttggggactgtggggggctgctggggacgctcacgtccatgtgcttcttttccagtgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59648 - DNA, 1194 bp, Homo sapiens
cgtgacgcgtgggtcgacccacgcgtacgcaggacgcgatgggtgagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaacacacaccacaaaaagggacgaacagaacaaaaagatatcctcgaagtggggcacagcatacccccgataacccacacaacagaggaacacacgtgcaccatacaagcgaacagcaccaacacaccaagaactgagccgaagaaaaaaaacaacaaaaaatgcagaaaataggaacgcacgccgaaaccacacgaaacacgcaccaccaaccaccaggcagaacgcacaacacccggacaaaagcacacacaacagaccaatacacagcccaaacggcacacccacccaccccaacgaagcacacacagcatgcacagccacccacaccacgcacacacccacaaaacacggcaccaagcgcaacaaaacacacacacacaactacacaccagcaacaacacgccacaagacacagaaacaaaacacaaaaaagacaacaagcagaaacaaaaaccgaggaagaagaacaaaagaagagcgcattacacaggccgatccaccgaagacacacaaagcactaaggcaacaaacaacaacaagaaccaccgacccccacacgagaaagaagaacggagaaaggacagacaaaaggggaaacgagaaaacacaacatctctcagcccacttcgcataaagacgcgcagacgaacccgaccagacaa

SEQ ID NO: 59649 - DNA, 958 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaaaaaataaaaaaataaaaaactcgagactagttctctctctc

SEQ ID NO: 59650 - DNA, 865 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgggctcggcgcccccacccctggctaccttgtgggaataaacagacaaattagcctgctgga

SEQ ID NO: 59651 - DNA, 1349 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59652 - DNA, 1482 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59653 - DNA, 891 bp, Homo sapiens
agcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaattcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 59654 - DNA, 661 bp, Homo sapiens
gcgatccaaccacctcagcctccagagtatctgggactacacatgcatgccaccacacctagatatttttgaataaatgaatgacaagaatgagcaaaccttgtcttgggccccagtgtgctgtgtagagcagagaagaagtgtcaggagccctctgtatagacaagggtagagagaagctcaggaggtccttagcagcaccctgtgggagagcagggaaggccacaggaaacctgacccctaagacctgggtccgggactcaagagaatggaaatggagaggaaccaagaggaagcacagactggtagtgggcaccctgtcattggagctatgtgaggcgataaggtttggctgtgtccccacccaaatctcatcttgaattgtagttcccataatccccacgtgtcatgggagggacccgatgggaggtaattgaatcgtgggagcggtttcccccatgctattcctgtgatactgagtcagttctcacaagatctgatggttttataaggggctttttcctttttgctgggcacttcttgctgccgccatggaagaaggatatgtttgctcccccttctgccacgattgtaaatttcctgaggccttcccggccctgccaaacttggtcaattaaacctctttcctttataaattacc

SEQ ID NO: 59655 - DNA, 2275 bp, Homo sapiens
tttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttctttcagagtcaaccttgggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 59656 - DNA, 431 bp, Homo sapiens
cggcacgagggaagttactgctgctgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 59657 - DNA, 1021 bp, Homo sapiens
tttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttctttcagatctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 59658 - DNA, 2221 bp, Homo sapiens
tttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttctttcagagtcaaccttgggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagtaaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 59659 - DNA, 2463 bp, Homo sapiens
tttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttctttcagagtcaaccttgggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggtacctgggccttttatttaacatctatatttgttttaactctcttggcagatgtgtgaaaggattcttgcttgatcaaacactaagtatttttttggttcttgtttttctttcaaatagccaggtttttttcttttggtatttgcataaaatgaaaatatcaccgaatattaaatcactgtggatccatt

SEQ ID NO: 59660 - DNA, 1004 bp, Homo sapiens
  misc_feature (912)..(912): n is a, c, g, or t
  misc_feature (918)..(918): n is a, c, g, or t
  misc_feature (927)..(927): n is a, c, g, or t
  misc_feature (932)..(932): n is a, c, g, or t
  misc_feature (934)..(934): n is a, c, g, or t
  misc_feature (940)..(940): n is a, c, g, or t
  misc_feature (944)..(944): n is a, c, g, or t
  misc_feature (949)..(950): n is a, c, g, or t
  misc_feature (958)..(958): n is a, c, g, or t
  misc_feature (966)..(967): n is a, c, g, or t
  misc_feature (974)..(974): n is a, c, g, or t
  misc_feature (985)..(985): n is a, c, g, or t
  misc_feature (989)..(989): n is a, c, g, or t
gcgctaggtacgaggcctggtgttggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgccggtgctggggggntcctcnccctgggcncccgncngccccntggncggcnnggggcctnccagggcnngccccangggtcccggcnccgncctggcttgttgccg

SEQ ID NO: 59661 - DNA, 2160 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59662 - DNA, 2131 bp, Homo sapiens
ggctggtaccggtctggagagtttgggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59663 - DNA, 2181 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctgaaaaaaaaaagaaaaagaaaaa

SEQ ID NO: 59664 - DNA, 2370 bp, Homo sapiens
  misc_feature (2169)..(2169): n is a, c, g, or t
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctgaaaaaaaaanaaaaataaaaaaacaattcccggggctctcctaatgtgccggggggggcgacacaggcggggctctcgaatttggcgaccttgggtcattacgtgtgtttccctggcccccactctttttttttctacccacgggggcaacactccgcggggccgccccaaaaaggagggccgtaaaatccgaaaaccccggtacctggta

SEQ ID NO: 59665 - DNA, 2082 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctccttgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59666 - DNA, 2034 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59667 - DNA, 1699 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59668 - DNA, 2120 bp, Homo sapiens
  misc_feature (28)..(28): n is a, c, g, or t
  misc_feature (32)..(32): n is a, c, g, or t
  misc_feature (35)..(35): n is a, c, g, or t
  misc_feature (40)..(40): n is a, c, g, or t
  misc_feature (43)..(43): n is a, c, g, or t
  misc_feature (45)..(46): n is a, c, g, or t
tatttcattctggggcggggctttaatngatnctngtacngtncnntttcttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59669 - DNA, 1902 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59670 - DNA, 1989 bp, Homo sapiens
cggacgcgtgggtcgacccacgcgtccgagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59671 - DNA, 1686 bp, Homo sapiens
  misc_feature (10)..(10): n is a, c, g, or t
tatcgggctntagaacgagctgcgtggtgaagaagcttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59672 - DNA, 731 bp, Homo sapiens
cggacgcgtgggtcgacccacgcgtccgaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59673 - DNA, 679 bp, Homo sapiens
gcaaccaatagctagtagaggccgggtggtgaatcggccgaggctggacattgtcagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59674 - DNA, 811 bp, Homo sapiens
cggacgcgtgggtcgacccacgcgtccgagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggtgagggactcccttctcagcctatcatccacacttgtgtttacttctttctacctgatcacctttcttttggccgccccttccaccttaacttctgtgattttctctaatcttcattttcctcttagatcttttctctttcttagcacctagcccccttcaactctatcataattctttctggcaactcttcctcaattgtagtcctaccccatggaatgcctcattaggaccccttccctgtccccccatatcacagccttccaaacaccctcagaagtaatcatacttcctgacctcc

SEQ ID NO: 59675 - DNA, 941 bp, Homo sapiens
  misc_feature (740)..(740): n is a, c, g, or t
cggacgcgtgggtcgacccacgcgtccgaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctgaaaaaaaaanaaaaataaaaaaacaattcccggggctctcctaatgtgccggggggggcgacacaggcggggctctcgaatttggcgaccttgggtcattacgtgtgtttccctggcccccactctttttttttctacccacgggggcaacactccgcggggccgccccaaaaaggagggccgtaaaatccgaaaaccccggtacctggta

SEQ ID NO: 59676 - DNA, 2136 bp, Homo sapiens
cggacgcgtgggtcgacccacgcgtccgagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59677 - DNA, 2362 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctgaaaaaaaaaaaaacaacacaaaaaaaactccgggcgcatatatatgccggggggcgcgaacacaccgggctctgtcgacacggcgaccattggcccatgagctgtttttcctgacccccgttttcttgctcccacgggtgaaacttgcacggtctccccataagggaagccgaataaattcgaataacgcgggttacctgtaa

SEQ ID NO: 59678 - DNA, 2181 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59679 - DNA, 1677 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccatggtattgaaagttccgagatcctgcaggctataccgtcctgttatgtgaatgtatttattattatctgttccatataacacattactttcctattaaacctgcttgtatattttatatcctaattttctgtttaatctt

SEQ ID NO: 59680 - DNA, 1487 bp, Homo sapiens
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccccccttgacttggcaatgcggtaaccagcccaacctttaagggctggctgaagagacaagttccccccttggcattctgtgtttcctgtaattcgaatattgggttccccttttttccccggttccaaaacaccccttggggaccacattttggttcccaagcggctacatttggcacaa

SEQ ID NO: 59681 - DNA, 1034 bp, Homo sapiens
  misc_feature (942)..(942): n is a, c, g, or t
  misc_feature (948)..(948): n is a, c, g, or t
  misc_feature (957)..(957): n is a, c, g, or t
  misc_feature (962)..(962): n is a, c, g, or t
  misc_feature (964)..(964): n is a, c, g, or t
  misc_feature (970)..(970): n is a, c, g, or t
  misc_feature (974)..(974): n is a, c, g, or t
  misc_feature (979)..(980): n is a, c, g, or t
  misc_feature (988)..(988): n is a, c, g, or t
  misc_feature (996)..(997): n is a, c, g, or t
  misc_feature (1004)..(1004): n is a, c, g, or t
  misc_feature (1015)..(1015): n is a, c, g, or t
  misc_feature (1019)..(1019): n is a, c, g, or t
ctaagggtatggggcaaggatcacatctaatgctagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgccggtgctggggggntcctcnccctgggcncccgncngccccntggncggcnnggggcctnccagggcnngccccangggtcccggcnccgncctggcttgttgccg

SEQ ID NO: 59682 - DNA, 1830 bp, Homo sapiens
caattttaggggtttgatatacaaaaaagaatgccagggtttgagagtgactctgtatttatctttcagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59683 - DNA, 1974 bp, Homo sapiens
cggacgcgtgggtcgacccacgcgtccgagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59684 - DNA, 1204 bp, Homo sapiens
  misc_feature (10)..(10): n is a, c, g, or t
tatcgggctntagaacgagctgcgtggtgaagaagcttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccctagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaatagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 59685 - DNA, 476 bp, Homo sapiens
ttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggtattgggaagggcgttggctgcggtctgtgacgttttaaacgtcttcagtaaacggtactgaccgcta

SEQ ID NO: 59686 - DNA, 919 bp, Homo sapiens
ttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggatgccaaaaaccatggaagacttctgatgttctgggagggttgacaaagatggaccttaaattctagaatttaggtattcatggttgagatcctgaagaaaacattttctgctgagcagaagcaatttaataattgcctcccttcatttcagaatccagaagtgtctgcagccaaccaaagagggaatgtttgatggacagaagttggaatggaaggagaaaatggcttattttagttaaaatgttttacttttggaaatttttttaaaaacttattttcacatatcacataaatacattgttaggacccctcccagggccatagaagtggcctgcacagacatctggttttaaagtggcagtacagaagcaagctggtttcactgtccccacagaaaaccaaaaatatacagagctgtgattttccccagcaacagtccagaactcatatatgaggatgagacagatcctagggccataaagaaaaaaacttctttggaaaaaaactcca

SEQ ID NO: 59687 - DNA, 667 bp, Homo sapiens
ttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggatgccaaaaaccatggaagacttctgatgttctgggagggttgacaaagatggaccttaaattctagaatttaggtattcatggttgagatcctgaagaaaacattttctgctgagcagaagcaatttaataattgcctcccttcattgtaagttttttatttcttccttatgtctgattaatcccccaatataaacttcaattaattgagcagctctgcaaaatatatgaataaaacaccacatattaagatattata

SEQ ID NO: 59688 - DNA, 338 bp, Homo sapiens
ctttcattttctctctcctggccattgtagtattttatgtcatatattttacttctaaatgtgttatatattccacaatacgttgttattaattgtggttaaattatggagatttctagcaagtcttatattacccatttatttaccatttctggtgtcctttattcttttgtctagattggtttctatctgttattttcctttagcctcaaggacatcatttaccatttctttagtgcaggacggcgagaggcgaattatttcttttatatgtctgacaaaatctttattttacttttgtgtttgaaaggtactccatataagtataaaattccaga

SEQ ID NO: 59689 - DNA, 416 bp, Homo sapiens
cacaggctggacacaggaaccacaactttgggttaagttacccacacttctatttctgggatactgcagcatatatgtgtcctaaaatgcttttggaaaacaggagtagccaagctcaacacatttttaccaacacctactagtttccacttttaattcaagtaaccaatacttgattatttagtagctacatgaggactgcagccctggattctgccaccaacatgctgatacctgacacctattgactcacccaattaaattcttctctctcaggatcacattcctgtttttatgtgggtgaacagggactgagacaatcagtgctgtagttatttttcagctcagaaggaaattgttgtcatttgacacctagatgcataacccaaattgaaaataaactatatattatcatt

SEQ ID NO: 59690 - DNA, 317 bp, Homo sapiens
aaggcagagaaaataacgtgagcaaagacagtgatgagaaaacctacagctaatgttaagggaggatgaagggagttagaggaacccatggggtaagaccatggatggcctagagtagcaatctaagatatctagatatcatttgatagttattctgcattgcacatctctccttgtatacagttttctgcctattaaaatgtctatcttaaaatgtactgaccatgtggtactaataatagaactttccagatgagaccctcaactatttactgctgaaagctaatggggcaagaatcgacacgaggataacagga

SEQ ID NO: 59691 - DNA, 415 bp, Homo sapiens
agattttcctttgtgtattagctacctattgctgcatagcaaattgccccaaaacttagtgatcttaaaacaacaaacagtttttatttcataatttctgtggatcaggaatccaggcatggcttagctgagtcctctggctcagggtctctcacagactgcaattaaggttggtcagggcactgtcatttcaaggctcaactaggaaaattgtctcaaaagaaaaataaaataaaataaaacaaaacaaaacaaaattagccaggtgtggtggtgctcacttgtaatcccagctactcaggagtctgaggcaggagaatagcttgaacctaggaggcagagtttgcagtgagtcgagatcgcgccactgcattccagccttggcagcagagcaagactccgtgtcaaaaaaaaa

SEQ ID NO: 59692 - DNA, 324 bp, Homo sapiens
ccattcatctattgaaggatatcttagttgcttttacacattttcatctatgtgtcctgtgttacagccacttcaaactatcttcaggtctctgaatgtgccgtgtactttaattcttctgttccactgaccatgttgttttctctgtctggaacttcctgtatgcatcctttcactctactgcacacctcacgcacagccagattctactggatgcccttctcatattcttttatactattgcttatcaagcttcaatgtgcaattagttatccacagatcttttaaaaatgtagagcctgattcaataggtgtgcggtggaa

SEQ ID NO: 59693 - DNA, 1127 bp, Homo sapiens
ccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctctgtcatcagactatacagtaagtag

SEQ ID NO: 59694 - DNA, 271 bp, Homo sapiens
tctgttgtgaaatgatagtgatattcacttctatagtttaaaaatatgttctgtgcagcataaataattgataagcagtgttatcttgtactttcagattggagttgcctttgagagtcaaagatttgtagctcacagaaaataaagaagtactgtgtgggtgtgcctgggagggagttttgctaagaattcttactaaataaagttcaatcagtcaaatgttattgtactcttcaaattctccagggaaataaattgccagcttccattt

SEQ ID NO: 59695 - DNA, 386 bp, Homo sapiens
gccaaagcctgccagaagctagagaacaatgaagcttattgagaaagtccttacaggtcaggctcctggggcagaacgaaggcagagaaagactccaagaggatcctgggggctcctagagaagctaactgcacacagtacctataaagtttattatgaggattaatttagcacaatgcaggtcttggccactgaaaagcttattaaatatttttttctgtcttctttcttaactatcttgattgttatccactattagatgcttggccttgcaaaaagaagctttcagtcaccaagttatttcactgagaaatcttgagattttggccgaaaagtaactccagagtgctttccttagcctgtcatctaatcagttcatctactcc

SEQ ID NO: 59696 - DNA, 362 bp, Homo sapiens
gctttatggcctaagagacagttaatatcataaatcatctatgaattcttggaaaagaatgtttcctgcaaattgtctgcaagtttctataaatgtacttagatcaaattttctgtgctcttagtaatgttttgcctctttagcaatcacagagagatttgcttaaaaatcttgaacactgagagtaccatggccacaggaagatttttattctagatgacatggggcatttccggtagttgtacagcagaataaatttacatattctttttttttttagttcattttcctcttcactttactctttatatttctagttagttataacataatgtctcgacatcatgacacagtgcataggg

SEQ ID NO: 59697 - DNA, 277 bp, Homo sapiens
tatcactgttacctgacaatgtgacgttacatacaaaaagccacaaagactccagaaaaaaactattagacctggtaaatgaatacagtaaagttgcaggatacaaaatcaacctacaaaaaatcagtagtgtttctaagtactaacaacaaactatctgaaaaagaaatcaagaaaacaataccatttataatagctaccaagtaaaataaaatacgtaggaatacatttaaccaacaaggtgaaagagccatacattgaaaactgtaaaacattg

SEQ ID NO: 59698 - DNA, 536 bp, Homo sapiens
aaaaaaacggataaattagtattaaaaatgggttgtttattttttaggcttttaattacaaataaaacaggaggtattttggcttatattggcacagtgccattataagtggtattataattatgtgttgacacttcaatcctatgaactttgctaaaaataaagattgtctatacttttctaaactgtcgatttcttcctttggcaaccttctttactcaatttcagcttgaacttcttgtactcatagtctttatcgccccagatttctggaaggcttgatagtgttggactcaaatatatacttgtaacagactcctaagcaaataaggctaatggttataaaaggcttctaaaatctggatgtaaatactgagttgtgttgataatttgcatgattaggggaacactggggaggattccagacatcttagagcgcttctgaagtcctaaaaataatttgcatgttttggaatgaaactatgatgaatattctgtgctcacttttgagtctcatgatgttctcaggattaaaa

SEQ ID NO: 59699 - DNA, 303 bp, Homo sapiens
ttttaaacaaccaacaattctcttcaggacaagtatttaccatacaagatcatttcttatatagaatctctttcctttataaccttctttgcatagccagagtgtgacatattaccaaacccaatagtaacagactcagggattgtaaaactttcatgttccctttttatttgtaactattaaccctgctataaggataataattaagcaaaatactagagcaatggaaaccaatatttcagttagaaggtgctactgtgtatagctcccagcaaatagtaaagtgagtagcagttcctcaaa

SEQ ID NO: 59700 - DNA, 398 bp, Homo sapiens
ctgagcgagcatctgatataaaatgagataggctttatttaagttgcatcaatgagtcagcagtttccataagaagcctatggggtcttagggtagaaaatccaggataaagtcctggtgtgtggctcatgcgtgtagttctagcacctttagaggccagggtgggaggaccacttgaggccaggagtttgagaccaggagtttgaggcaacatagcaagaccctttctctacaaaaaatttaaaaattacccaggcatggtggcgaatgccatatagtcccaggtactgcagagactgaggcaggaggattgcttgagcccaggagttcaaggctacaatgagctatgatcacactactacactccagcctgggcaacagagcaagaccctgtgtgt

SEQ ID NO: 59701 - DNA, 866 bp, Homo sapiens
taaagacacctttccccagccacatctggcacagtagtgtggcggaattgacatcgttactccagtcacctagagcagggtctcagcacccaaccttcccctcattgtctccccttcggcgtcttgagaaagggaaccagtccctaatcttttaggcacgtggctcccacccctctatcttggggaatgggcgtgcgccctgaaagctcagtagtgtcctccctctccacctcctgtagttctcatggtgccagcgcctggcccacccacattgtgcaatgaacggcctggcttcgtcattctatgtagaatgttttagagttcccccgtcggagacagcttcaaatttttgccatgctattttatcaatacgaaatcttagtgccaaggttcttttgctttaaggttttcccttagaaacacccagatggcggccgtcttgcttaactcacaggtgaagcagagaacgctccctgaaacaggcttgaatctgcaaagaatatctgaacgttgttgggcaagttaattttcgtgttttgcaccttaaatgagtaaaagaatatggcgctctttaaacagttgggagacagggcggagagggagaatgctcaaaggcactgtggtagttaaatctttttgagaggcttaaattttcatcaggctggtatgaactggcagttctcagccactgctactaacctacttttttagaatgtaggtttcaaattatagcccacagatataagctactctatactaaaatgctgagtaattttcattttgagtaactaaaggcaaacattcttgatattgcattgaggagcactataatacataccttggttttcttttggtactaaccaata

SEQ ID NO: 59702 - DNA, 1147 bp, Homo sapiens
taaagacacctttccccagccacatctggcacagtagtgtggcggaattgacatcgttactccagtcacctagagcagggtctcagcacccaaccttcccctcattgtctccccttcggcgtcttgagaaagggaaccagtccctaatcttttaggcacgtggctcccacccctctatcttggggaatgggcgtgcgccctgaaagctcagtagtgtcctccctctccacctcctgtagttctcatggtgccagcgcctggcccacccacattgtgcaatgaacggcctggcttcgtcattctatgtagaatgttttagagttcccccgtcggagacagcttcaaatttttgccatgctattttatcaatacgaaatcttagtgccaaggttcttttgctttaaggttttcccttagaaacacccagatggcggccgtcttgcttaactcacaggtgaagcagagaacgctccctgaaacaggcttgaatctgcaaagaatatctgaacgttgttggccctgggactaaaataaaagagaaggtaatagtttggttttgcagctgttctggatgtttaccatcgagatgattatttatagcagctgagttgaaaactaaagtatttgaggcacagaagataggttttctttttttgtaagtactgacttaagtgtgacctttagcgagtgtgggtgaaaatctggtaaagtcctagcaaatcaaaattgaaagcgtgaaagctgacgtgcagtctggctttaccctctacccttattttcccttctccccacctgaagacacatcgtgtagggccatcgatttttgttttaaacaaacaaaatgctaaaatatcaaattatgctggagcattcataacatgaaatttagtgttccagtgtttttcattgtacagttcagtggcactaagtctattgaaactgttgtgagagccatactttcgacaaggtagttaaaacatggaaattttggaacgatgttcttttggacagatttttgaggagttgaatttcaggactgtattgcaaaatgagataaaaatcttgatcttgttaagtaaacacaaagaattgatgtgccttcttcttagctttgtccttgcagaaaacagaagaggaagcactttga

SEQ ID NO: 59703 - DNA, 473 bp, Homo sapiens
aattttttttttgttcaacccctcttcccctctcccactcctcccaccccattttcaccttccttccacccccacctgggtgtacttttgggggtactggccactgtgatgtgagaaacttcacatcctgttaaccagccactccttccatcccctccctccctgttcccttttcctttcctccttttccctaccccattgccctgaagacccagctccctttttgggaggttatgttgtgggggggaggagggcatagtgggagctgcaaatgcctatggaggggaggtgggagaagacaggaattagaacccagtggtttttgtttacctgtgatcagctccctactgttagggactcagctagcatccagtgttcttaaggtctttaggcagatagagaaataagttggagaaagggaagtgttttaaaacataccatgtaggtttgtgcagttagagatcttccacatc

SEQ ID NO: 59704 - DNA, 327 bp, Homo sapiens
gactacaggtgtgccccacgatgcctggctaatttttaaggtttttgtagagatggggtcttcctatcttgcacagactggtgtggaattcctagctcaagcaattttcctgtctcagcctcacaaagtgctggtattacccgtgtgagccaccgtgctcagcccagtcatgtatttctaattattgtatttgtgaactaatctatgaacaacaaaaacaaacaaacaaacaaaaagggtggcatttctgggccaccaggaaggtggattggggttgcagctattttcaaattatattaaaagcaggatcccagttagagcgctatc

SEQ ID NO: 59705 - DNA, 380 bp, Homo sapiens
tctcagtaagtagtctttctaggcaggatttttcttccctgcttaagggggttagacctccaaaatatttgtcagggtctcttttccttttaagggtttaacccacaatcttttctgtatccgttttgtaccagctccattcctattctcaagctttggtgcataaaaccttagtttaggtgtctatatataccactactttggcctgaaaattagaatcgtggctcacacttgattctaagttccctagtagtggcgtgtttcctttctacgtgcttactttcccacctgacctgcttttccccaccgtgcagtctgataattggtattatttgttttgattggatctcagaaattacctctttagaccgagctgtgct

SEQ ID NO: 59706 - DNA, 283 bp, Homo sapiens
ctctatgatgacctgcgctgtgacccggagcgcgatcacttccgcaagatctgtgaggaatatatcacgggcaagtttgacccccaggacatgaaactaaaaacttggacctcatcctcaattattttctcctttcaactctgttgaccctctgtctggtcttcctctagaaggttttaccgcagaaattgatgtgtgctccctgccctcgtcactgcccaagcccgggcctgcacatactcactggactgttccagttttgacagctgccagtcttctgccc

SEQ ID NO: 59707 - DNA, 391 bp, Homo sapiens
caaaggctaactcttaataagaagatgaggaaataaaatcagttcaaaagggaggaatatgcattcccagaattaaaggaccccgggtccagtttgaggaggactcttggccagatacaagccccttgtataatgctcaagagggaggagaccttatttgctccttggaggtgtctagtatgaaaactgcttattttgaaatgtgattctagccattatcaggagcaactgcagataattcccatttacagaggaatgctgctaacaggtgtgggagggagcagcgacaacgaaaaattctgctgtcataggtcacgtttatgttggttttcttgaaaatcaagggtagaaaatttcatgcctctagagagagagagaaaaacacatgagg

SEQ ID NO: 59708 - DNA, 458 bp, Homo sapiens
  misc_feature (173)..(173): n is a, c, g, or t
ttttgtaaaaatgtgtgagagggcagctctcatgttgctgcagggctctggagagagacaggcctgacctctcctctccactgtcttgttttgatcttaggcaagttattttagtctgttcctcccaggggacctggtgtccacatgaagattagagagagggtgtcaagaancctggcaggtgctaagcagtagatgctgctgaaatagatggcagtgcttctcaaagcatgttccccagtccaagagcctcagggtcacctgggaacttgttagaaatgaatattctcaggcctagactccaacaggaactccgcaggtgggcctagtcatctgtgtattaacaagcacaagaccatcctcgtgtacgctggagtttgagaaccactgataacctcactaaccattataaggtcaacttaaaggtacctcacttatttttttttttcttaattaaa

SEQ ID NO: 59709 - DNA, 2252 bp, Homo sapiens
ttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggttaaaaaaa

SEQ ID NO: 59710 - DNA, 1262 bp, Homo sapiens
acgggttctctcttgacttcgctcaataaaaatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggttaaaaaaa

SEQ ID NO: 59711 - DNA, 1328 bp, Homo sapiens
tcttaacactggcacaccaaacccttgacattgtaagcaatatcttgggcatatgtgtatttttctgggctaggagtccataactttaatcagattctcatgggggtcctggcataaaaaaattacatggatttagagtagagagagagtatgttgggggtcgggtgcaggaatctgcctttccaacagtcactcaggtcattttagtcctggggcctgagggttgcattttgaaaacggtcttagtgggttccctaggccaggattcctggcttcttgtgttcccctgggctgccccttggctcctgcgcctaccacagtgtctggtccttggtagagtcgccaagtaagcgttgctttttcactcagggaggtggcttgagggtgcacgcgagtcggataggagcaaacctgggtctcatctcggtgtctcttcttgtctcccggtgtggcgcggcgcaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggttaaaaaaa

SEQ ID NO: 59712 - DNA, 1726 bp, Homo sapiens
ttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtaaggcagttctggctccagcgcacagcgccctcgggcgggcagcagcgcacggcctagtctggtaggtcccctccatcccggccgactggcctcctgcggtgcaaacgcaagatcttgactttcaagaggctttgtggactacgcaacttgaggcaggagaagaggagggtggagatggggtgagggagaaggaccgagagaagagctcatccccaagatgtgtgtcaacaagcactgcatgtttattttggccaacaggctaaagaaccacggagaaagcaaaagggccgctggaaataacactgatacactcaactgtagtgcaattcgctgtagg

SEQ ID NO: 59713 - DNA, 400 bp, Homo sapiens
gagaaaactgagacttcatcaggtgaagcaacttgtccaaggacatgccactagaaagaagtgacctatgattcaagcccaggcaatctattacagaaagccccactcttcactgccccactgtgctgtcttccaaagagcatgaataactagactggatatttacagactgtttttctttaacaggcaagatggacaaaactgttcagaagtggttgtttgtgcctatctaaaggacttcctgccctagcaacatttggtccacatccctaagctcttctttgctttgactcaatttatcttccaaagccgaagtcacaacaggatgatcttccttcagagaacccccagaaagttgtgttttcatcagccagaaattccagagaacttggggggaaaa

SEQ ID NO: 59714 - DNA, 635 bp, Homo sapiens
gtttctgatatcacattctttcctgaatattcgccttgggtcttttcctctgggtgagcttgaactggtcaacatgcttgttgaaatggtgcccagaatagcatggattatttcagagatgatatgaaaagggaatatgcttggggattattagttcctgggaaagaagcattactaatgtagctaacatggaagtttgtgtttaaagatatatcacgttactcattttcaacttatgaacaactaaaggtacagagatttttcacttcatttattaacaagacagagttttcctatcccatgcttgtaaaattgattttaaaaaattttttaggataaaaagtgacatatgttcactaaatgaaagttgaaaatgtgaaaaaatgaaaaaaaaaccatcatccataagaataggtgtcattttctcagcaatgtttgctcttcatgatttaaaaaaatacaagcatgattataaaattgaacatactaattctaaaattatttttttctgatagaagtaatatacaatattactaatagtagaaaaaaattaaatatgggaaaatataaagaagacagcttttcccacaaatgatattgagtatttctgcctgtgtttatttgccatctgcata

SEQ ID NO: 59715 - DNA, 492 bp, Homo sapiens
ggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatga

SEQ ID NO: 59716 - DNA, 846 bp, Homo sapiens
cggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaagccccgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggag

SEQ ID NO: 59717 - DNA, 529 bp, Homo sapiens
ggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggag

SEQ ID NO: 59718 - DNA, 397 bp, Homo sapiens
tgcaacttctctcccagtgcgagagcgcggcggcggcagctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggag

SEQ ID NO: 59719 - DNA, 215 bp, Homo sapiens
  misc_feature (63)..(63): n is a, c, g, or t
  misc_feature (76)..(76): n is a, c, g, or t
actgtgatagtgtccgttttctttatgtaacaaaatctaatttctttgtgctaaggcaagagnagttctaaagagngaaaaaagaacactttagcagtcaggacaaatgatggtatttcgttattattttcatcatagattaaaatatatccctcatactttgtaaataggagtctatcagagatacactgtgataagggcaagacaattagaaa

SEQ ID NO: 59720 - DNA, 663 bp, Homo sapiens
aagcttgcggccgctcgggagagcgcagacccccgctccagcgccggccagacgtcgtgcagcggcgacttgagaaacttttttcctctttttatttacacgggagcactccacagtgttttgcagctttcctatttcactaaactacagcccattctgctctgataagtagcagcgttgccctcgattggctgcacccgagttctgaccctcctcctccagcgagggcctcggcagccagcaagatgggctcccgctcccggaatggactcggaaactttaactgcggctccacctgctggtgtggattaggacaaaggcggagaacaaagtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaat

SEQ ID NO: 59721 - DNA, 603 bp, Homo sapiens
  misc_feature (595)..(595): n is a, c, g, or t
  misc_feature (598)..(603): n is a, c, g, or t
gaaatttatttccatgtaattattttgctttcaatttatggaaacacagaccatgtagcaaaagtgccttaaaaatagcattgttgttcaagtagcattttcttccattgtctctgctatgtcttagggacacagatgagggaaacattgtctcagcctgaaagagccatgtctgctttctttgtcacaactatctggggatgcgacatgctaccttcagtgacaatggttccttagggcagtgattgtatgtgtgtgtgtaagtgcctttgtgtgtttgtgtgtgtgggagaatggaaacgaccctagggcaaaatatcaaagtgaagggaagagtaattggagaagattaaatttgccaaaagcctctcagaaaatcactgttatctgggttccttataggattattaaagaggagaaaaataggcctttcatagataagtgaaaaaacaaatagcatttgtgaaaagaacccattttcattcataagcaatatagccaaatgtatttaaattaactctatatgaaaagttttatcattattactttcttatgaatttatttgaatctgaaataaatgtcagcccttgattanaannnnnn

SEQ ID NO: 59722 - DNA, 141 bp, Homo sapiens
cattccctacgatgaaggagtcccacttagagtgagtgacccagaagagaagtggacccaggatactccctggcctgggaagatgcctctacagcttgagacacaggcaccagtggctcaggcctgaggacagagacccag

SEQ ID NO: 59723 - DNA, 404 bp, Homo sapiens
ccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtacaatcttctccataagacatacattgtggttataaaaaggcaaaagtcttagtgagaatcattggtattccatagaagagtgaattaaacacag

SEQ ID NO: 59724 - DNA, 3144 bp, Homo sapiens
gcctggctccctctcgctgagacacacatacactcacacatacacaacccggcaggctcgtctgaacttgaagacaccccacattccaagatgcccgaggttcctgggaatgcctggggttcttcgatccggaaaatcctaccggcatcctcctagggagggattattattattatttttctttaatctggaagagaagagaacaagttgtgcttttccccccttcttcttgctaaatgccatggatataactgaataagcggctcagggctttccccgcgtggacgtccgaggccaccatctgcctgcattcgccggagccgccggagggtttagctcgagtctgtctcgggcggggaaggatgcgtggccgagccggggagcccgggcgccccgcggagccggcctcggtgccacccagccgggggtagatgctgcctcgcccaggcgctgagtgaccagaccatggagaccctgcttggtggcctgctagcgtttggcatggcgtttgccgtggtcgacgcctgccccaagtactgtgtctgccagaatctgtctgagtcactggggaccctgtgcccctccaaggggctgctctttgtaccccctgatattgaccggcggacagtggagctgcgcctgggcggcaacttcatcatccacatcagccgccaggactttgccaacatgacggggctggtggacctgaccctgtccaggaacaccatcagccacatccagcccttttcctttctggacctcgagagcctccgctccctgcatcttgacagcaatcggctgccaagccttggggaggacaccctccggggcctggtcaacctgcagcaccttatcgtgaacaacaaccagctgggcggcatcgcagatgaggcttttgaggacttcctgctgacattggaggatctggacctctcctacaacaacctccatggcctgccgtgggactccgtgcgacgcatggtcaacctccaccagctgagcctggaccacaacctgctggatcacatcgccgagggcacctttgcagacctgcagaaactggcccgcctggatctcacctccaatcggctgcagaagctgccccctgatcccatctttgcccgctcccaggcttcggctttgacagccacaccctttgccccacccttgtcctttagttttgggggtaacccacttcactgcaattgtgagcttctctggctgcggaggctcgagcgggacgatgacctggaaacctgtggctccccagggggcctcaagggtcgctacttctggcatgtgcgtgaggaggagtttgtgtgcgagccgcctctcatcacccagcacacacacaagttgctggttctggagggccaggcggccacactcaagtgcaaagccattggggaccccagcccccttatccactgggtagcccccgatgaccgcctggtagggaactcctcaaggaccgctgtctatgacaatggcaccctggacatcttcatcaccacatctcaggacagtggtgccttcacctgcattgctgccaatgctgccggagaggccacggccatggtggaggtctccatcgtccagctgccacacctcagcaacagcaccagccgcactgcaccccccaagtcccgcctctcagacatcactggctccagcaagaccagccggggaggtggaggcagtgggggcggagagcctcccaaaagccccccggaacgggctgtgcttgtgtctgaagtgaccaccacctcggccctggtcaagtggtctgtcagcaagtcagcaccccgggtgaagatgtaccagctgcagtacaactgctctgacgatgaggtactgatttacaggatgatcccagcctccaacaaggccttcgtggtcaacaacctggtgtcagggactggctacgacttgtgtgtgctggccatgtgggatgacacagccacgacactcacggccaccaacatcgtgggctgcgcccagttcttcaccaaggctgactacccgcagtgccagtccatgcacagccagattctgggcggcaccatgatcctggtcatcgggggcatcatcgtggccacgctgctggtcttcatcgtcatcctcatggtgcgctacaaggtctgcaaccacgaggcccccagcaagatggcagcggccgtgagcaatgtgtactcgcagaccaacggcgcccagccaccgcctccaagcagcgcaccagccggggccccgccgcagggcccgccgaaggtggtggtgcgcaacgagctcctggacttcaccgccagcctggcccgcgccagtgactcctcttcctccagctccctgggcagtggggaggctgcggggctgggacgggccccctggaggatcccaccctccgccccgcgccccaagcccagccttgaccgcctgatgggggccttcgcctccctggacctcaagagtcagagaaaggaggagctgctggactccaggactccagccgggagaggggctgggacgtcggcccggggccaccactcggaccgagagccactgctggggccccctgcggcccgggccaggagcctgctccccttgccgttggagggcaaggccaaacgcagccactccttcgacatgggggactttgctgctgcggcggcgggaggggtcgtgccgggcggctacagtcctcctcggaaggtctcgaacatctggacgaagcgcagcctctctgtcaacggcatgctcttgccctttgaggagagtgacctggtgggggcccgggggacttttggcagctccgaatgggtgatggagagcacggtctaggtgggggtgggcatgctccctttcctgtgcgcagggtgggagaaggggaaagaatctcactggcaagtgtttgtggagtttccatggtgatgtttacatccagggacagtttcgtctccctgtcaatggcctcgtgtccccccctaccccgcaacacccacatcacctccccaccacccggccggggtgtgctcagggaatgtggactcgctcaaatgccggactgagccctgagtgtttggaaaggcgagactccgcctttctaatcacaaatgtagcctacaagcaagcggctttggattgcttatg

SEQ ID NO: 59725 - DNA, 543 bp, Homo sapiens
aaataagccccccccggtaagagggtgggcccaaagaagtgtgaaaaagaagcccccccccggggtttgggaaagggggaaaagggggcggggttggggggggtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59726 - DNA, 594 bp, Homo sapiens
agcctatgggaggggatgctcacagcctctgcttcccctaaccacctcatcagccctgctacacccaagactggctgagtccctagaaggcacagtgactgggcactgttcaagcctggcatgatattcccaccacaggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccacaggatcttctcctcagcatgcttccaactcccatcccccaggcctgcatgcccaagcctccactgatccctctaattacctccctcctctcttctttgatctctcatctccctctctttgcctctctcccccacccccactttctccctctctgtgtcaacccctcactattctctgtgattgattccatttcaattcccaagactaccctgtgtctctctgtgtctctgtctctgcgtgtgcctcagcctggtctcatgggatcctcagagtcac

SEQ ID NO: 59727 - DNA, 5374 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59728 - DNA, 3867 bp, Homo sapiens
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59729 - DNA, 5331 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacaggctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59730 - DNA, 2545 bp, Homo sapiens
aaggttcaggtagaggcgggtgtgaatcggcaccgaggcttaagtcgaaagtcagatctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59731 - DNA, 1731 bp, Homo sapiens
agagtagatcgagctcggtaccagcggaacagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59732 - DNA, 1565 bp, Homo sapiens
ggagtctaggcagctgcaggaagaaatgatcgaagcaggcaggagcagcctcctcccactgtgaacggggtctaggcagctgctgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59733 - DNA, 4069 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagcaatagatgttaatatcttcgtttagcgaggggtatgtgccatcacaagcagatgtgggcagtatttgaaggccgtgtccagcccaccgcc

SEQ ID NO: 59734 - DNA, 3169 bp, Homo sapiens
  misc_feature (1089)..(1089): n is a, c, g, or t
  misc_feature (2742)..(2742): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtatattttatgtaaatggaatcacacaatatgtagtccgttgcgactgagttcttccacttagcaaaatgttttcaaggttcgtccatgttggaacactcatcagtacttcattcctttgtattggcagtagcagncaggattgaaaaaagggcaaaatctggcaggggggttaaagagggctataagcagaatggtccgggttgcccgtggacagggggtcccccctcgcgtcaggggtgaaaacataccgtgccgagtggaggatgtggccccacaaagggtctggaagaagaatccctcagaggcaagaagagactcggggccaagaggggagaggcagcaagggacctttgggaaaagcaccattaaacagaagaaacaaagggggacaacaccagggcaacatcaaaaagtacgcagggtatagccgcaaaggggagagacacactggcagcaaacagggagagaccatcaacgtgagtcgcatcatacgatcaatgatgatcgacttactatacgcgaccttcccagctcgcactcgcattccagcagggagggagt

SEQ ID NO: 59735 - DNA, 3172 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccacaggatcttctcctcagcatgcttccaactcccatcccccaggcctgcatgcccaagcctccactgatccctctaattacctccctcctctcttctttgatctctcatctccctctctttgcctctctcccccacccccactttctccctctctgtgtcaacccctcactattctctgtgattgattccatttcaattcccaagactaccctgtgtctctctgtgtctctgtctctgcgtgtgcctcagcctggtctcatgggatcctcagagtcac

SEQ ID NO: 59736 - DNA, 2450 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcgcggctgtgcggtcaaccaagaatccagagctctggccagtgcggcgggagcgggatcggccgctgtgggttttcggtgggcactggggggcaagggaccggatcagcagacatccg

SEQ ID NO: 59737 - DNA, 4824 bp, Homo sapiens
  misc_feature (1089)..(1089): n is a, c, g, or t
  misc_feature (4797)..(4797): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctccgttctctttccaaagtgtaattcccattttaaaaaatggattaaatgttcagaaagggtaaccacaatggnggtctcaaaaagtgggcaggagccaag

SEQ ID NO: 59738 - DNA, 4098 bp, Homo sapiens
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctcccttgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcaaaaaaaaaaatgcct

SEQ ID NO: 59739 - DNA, 2951 bp, Homo sapiens
  misc_feature (1089)..(1089): n is a, c, g, or t
agcgggccacatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcagggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcangaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtgtgagtctctaacccagctgtctgggctgggggacttgtgggtccactccaggtcggggctggtgaggggcctgaggccttgcctgcagggagacagatgttttgtggattggggaaaagatggggaggatgccgatgggggatgaatttctcaggatctaattgtaggggtctctatgatggaagggtgttctgggaaaaaaagtgtctcattggcctgggatgcagaaaataccttgtgagggatctcgggagggaggaagagcatctcagcctcttgacaatcctagcgaatgctaacatctggccaggtctggtgaatattcatttgtcagatgcccgaa

SEQ ID NO: 59740 - DNA, 1001 bp, Homo sapiens
acaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgagtgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctc

SEQ ID NO: 59741 - DNA, 501 bp, Homo sapiens
ttaaagcaaagaattccccggtcccagccatgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgcagcgcga

SEQ ID NO: 59742 - DNA, 995 bp, Homo sapiens
  misc_feature (526)..(526): n is a, c, g, or t
  misc_feature (528)..(528): n is a, c, g, or t
  misc_feature (535)..(535): n is a, c, g, or t
  misc_feature (540)..(540): n is a, c, g, or t
  misc_feature (543)..(543): n is a, c, g, or t
  misc_feature (547)..(547): n is a, c, g, or t
  misc_feature (554)..(554): n is a, c, g, or t
  misc_feature (559)..(560): n is a, c, g, or t
  misc_feature (566)..(566): n is a, c, g, or t
  misc_feature (577)..(577): n is a, c, g, or t
  misc_feature (579)..(579): n is a, c, g, or t
  misc_feature (583)..(584): n is a, c, g, or t
  misc_feature (589)..(589): n is a, c, g, or t
  misc_feature (598)..(598): n is a, c, g, or t
ttaaagcaaagaattccccggtcccagccatgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgcagcgcgaaaaaaaaacaaaacaacaaaaaaananaaacaanaaaanaanaaanaaaaaanacaannaacaanaaaaacaaaananaaannaaaanaacaaacanaagacagaggacaagagagcacaaaggcacagaacaacacaagaataagaggaagggcggacgacacgatcaacagcaacagcagaccgaagaacacgaaggacgagaaagagaaatgaggagggggaggtgtgggactaggaggaggagagggagagcacaaaggcgcagggacgccggtgaaaccaccacacgcgcaccggaggagcagagagagagacgacctacgtgggcggagagaccgcgaacggaaacggagggcaagagaaataacacggtgggcgggggcggcggaccgcacgacgaggcgagccgaacggagaagcacacagcaatgcgccagtacgaaaagcaagcagagaaagacagggaaacatgcggggagaccccaccaggt

SEQ ID NO: 59743 - DNA, 735 bp, Homo sapiens
ggctcactgcaacctccgcctcccgggttcaagcgactctcctgtctcagcctcccaagtagctgggattacaagcgcgtgccaccacgccctgctaatttttgtatttttagtagacacaaggtttcaccgtgttggccaggatggtctcgatctcctgacctcgtgattcgcccagtaggcatgagccaccgcgcccggtcgagggttttctcatagtatgtttagttgttctgaggagctttgtatctttgagaaatgcatgtttacaacatccacagtttcttctaaagctttcaggtgaactgcacacagttccactatgtcttctggggaaactcttgaatatcctggtacatcttcctttataaggactcatactgggcccactatgtaaaacgtggtttttcgggatattggaggttttgcaccacagagaattcaattcacttgggagtgttcatctatttaggaagtatagttttttttacttttgtcttcaggaatatgcactgctaccttttagaaataatttctattgcctttattatttttgttgttatttaatgggaaaaggttagacatggccaggtaaatgttatcaaataaagttagttattcgtattcaacaagtggaatttttactttgctgttctcagaaacccatgaatctgtgtgttctcagaaacccatgaatcattatgtatacaaattaaaaattgtaatgtactgctg

SEQ ID NO: 59744 - DNA, 753 bp, Homo sapiens
agccactccaccccagaagaaggtaatatgagtcctactacctttctgaaaggaaggtgagtacagaaaagcaagacagtaactttcccaagccagggaacccctgtctccccaacttctgcatcatgtagaccatttgtgtctacaacttacaggaggcagtgtagactagcagttgagaatgtgagtctagaatcagaatgcctgggttcaaacctcaactctgtcactttccagctatttggccttggacatattacttaaacatttgtgtgttttaaaacgtgtacacaatcctttgactctctttccatcaagaagtggagcctatgtcccctccctttgaacctgggtggaaatgtgggagtgcctagacaaatagaatgtggcaaaagtgacactgtgtgatttccaaggctaggttagaaaagaccctgcagcttctgatgattcctttagggacactcatgtcgggaggcttcagctgctgtgaaagaaactcagctaccctgaggctgccttgtagagggactgcatttaaagtgagagattcctgaggagttccagccatccagccccaagcagtgtgaacctcctagtctagaccccagcatttgagctgacctcagccccagccaccaattgactgcaaactcatgagacaccctgagtgagaactgcctagcttagtctctgtcaaccctcaaatttcaggaacaaaataaatgattgttgttgtcttaagaccactgt

SEQ ID NO: 59745 - DNA, 216 bp, Homo sapiens
  misc_feature (129)..(129): n is a, c, g, or t
gcacaaagcacttcttgttacagagagaaatgttttgattcattatttcaggaaaggatgccaaggaaaaaaagcagctgacttacaacagcagttcgtacatttcctggactgttgggatgtatcatntattccatttacattgcacctgcctcaggcacaggatatcactacgtaagagcaaacatattggcaagtaacaatatggtgtatgtg

SEQ ID NO: 59746 - DNA, 467 bp, Homo sapiens
tttgcatgtcaacatacagttttcccagtaccatttgttggaaagactattcctccattaaatcatcttggcactattgtaaataattgattgatggtaaatatgagggtttatttctggactttcaattctattccattgatctcagtgcctgtttttatattagtaccatactatcttgattactgttgatttgtagtaagtcttgaaattggagattatgagtcttccaatgttcttctttttcaagatggttttggctattctgggttccttgaaattttgtgtgaattttaggatcagttttttagtttctgcaaagaagccagctaggataagggattgcactgaatcagtagatcaacttaaggagtctcttcttatgttttctgttgctatgacagaatatcacagactgggtaaattataaaacaatacaagtttattcagctcagtgttctgggtga

SEQ ID NO: 59747 - DNA, 411 bp, Homo sapiens
cccgatttgtaatgtagtttaacagttaaggaaaattaactcttcctttattcagtgttcgtcctaattcttttgggtccccaattcactttactgtctggttaagatcaacattttctaacttagttcactttaataccttagattcatcagtttcttttacattaataattgctttggataaaattatttctaaatcatgttaattgctaaaagatcacttcaggaataattattctaattggccttattgcagaagaagcaaaataggagagaccagggcattacttttacaaatattctgagtaataaggggaatggacaatattgtaaaccagtattgttgtgtgctatcttgagtcctggtcctcagtgtgagctctttatacagttcaaacccagaaatgagcg

SEQ ID NO: 59748 - DNA, 270 bp, Homo sapiens
ggttttgggaggtttggccagcttctttactgcatcctgttttatctgcggagtctgctgaactcctatctcacagcatttgcctctgagtacagcagatgtcaacaaggttttgaactgtttgctctcagttccatattcttcctgtccccccaggattcattatattctcacctgggcttcagtaaacgaattttgcatggagagtttcagatgatgttcagtgacaaatttgtacctcagacaacttgggattcagaagaatatttt

SEQ ID NO: 59749 - DNA, 729 bp, Homo sapiens
aaaaggttccggcctcagccggcgcacctggcggaggaggaacctcgcgacgcgctctcgggcatcggtttctcccagcaaagcttggagggtttagctgcgcggagagctcagcgagctcttctgtgtctgtttggggcgtgtgggctccgggagcgtgaggaccgggaagctaggaggctccttcccttctggcggctccctcactgagaccgggcggtttggttgcgggggaagtggagacgagccacccttgacctttgactgcaagaactcaccttgagcaggatagaggcacgtggacggtgaccctcgggatgcaataaatgctgagacagatcagcaaacattgagtgggccagacactgttctgaaaaatacgcagtcgacttttgaacagcacaggcttgaactgcatgcggccactaatactcggacttccttctgcctctgccatccctaagacagcaagacccacccctcctgctcctcagcctactcgatgtgatgatgaaggggacacagatacacatacagagaagacaatggcatgaaggcagaggccgagtggagtgatgcagccacagccagggaatgccaggaacctctgggagctggaagaggccaggaaggatcctcccccggagcctctggagggagtgtggcccaccgacaccctgacctcagcttctggctcctgaactgtgagaaaataaatgtctgttgttt

SEQ ID NO: 59750 - DNA, 781 bp, Homo sapiens
aaaaggttccggcctcagccggcgcacctggcggaggaggaacctcgcgacgcgctctcgggcatcggtttctcccagcaaagcttggagggtttagctgcgcggagagctcagcgagctcttctgtgtctgtttggggcgtgtgggctccgggagcgtgaggaccgggaagctaggaggctccttcccttctggcggctccctcactgagaccgggcggtttggttgcgggggaagtggagacgagccacccttgacctttgactgcaagaactcaccttgagcaggatagaggcacgtggacggtgaccctcgggatgcaataaatgctgagacagatcagcaaacattgagtgggccagacactgttctgaaaaatacgcagtcgacttttgaacagcacaggcttgaactgcatgcggccactaatactcggacttccttctgcctctgccatccctaagacagcaagacccacccctcctgctcctcagcctactcgatgtgatgatgatgcagagattcagagagtctaagcaacttttctaaatcatctagctggaattcgtaactgagccaggatctaccccaggtctgtctgactccaaagcctgtgtcttccagcacacactgctgctgcctggggaatgtggatatgatgtctggagctctagcaaccatatcagaccacaaggatgaatgtacaccccaggaatggaagagaggaaagccagaaaaagactcggtccctgatggctgaagagctaccatacctgcccct

SEQ ID NO: 59751 - DNA, 1443 bp, Homo sapiens
aaaaggttccggcctcagccggcgcacctggcggaggaggaacctcgcgacgcgctctcgggcatcggtttctcccagcaaagcttggagggtttagctgcgcggagagctcagcgagctcttctgtgtctgtttggggcgtgtgggctccgggagcgtgaggaccgggaagctaggaggctccttcccttctggcggctccctcactgagaccgggcggtttggttgcgggggaagtggagacgagccacccttgacctttgactgcaagaactcaccttgagcaggatagaggcacgtggacggtgaccctcgggatgcaataaatgctgagacagatcaggtgtgcaaggcacagagctagaggccagaggcctttcttctccaaccttcagtcacctctttttaaagtgaagccagcatcctcctcggggtttactgtgaaaattaagtgagctgacgcgtgctgtgttttgatgttgcttggctcctacaaacattgagtgggccagacactgttctgaaaaatacgcagtcgacttttgaacagcacaggcttgaactgcatgcggccactaatactcggacttccttctgcctctgccatccctaagacagcaagacccacccctcctgctcctcagcctactcgatgtgatgatggcctgccggagatcagaggcccagattattgaaggagacgcctatgagatgcccaagcggttgctgtgacaactctgctggagggcgggaggcggcgagggcgggcagctgactgttggctgtggacaggctccaggcgtgccaggccagagtggggataattccaccccaggttgcttagctgagggttctctgcgcattaagcaccttaactcgctgtcctgctgcaccccagccacagaggccttggtgaaggtgaaatcttagagaatagctgggaagccaaaaggccaagcagtttgatgactatttccttaaagctgatgaaaaagcaacgtggataatatttcctaacaataatggccagcagttagtgttcactgccaggcccctgcccagtaccaagagctcaggttttacatcagcatgacgtgacctatgtggaatccctggctagctctgtgaccttgagcaaagtcactcaacctctctgaatctcaggcactagtgttgaccatggacacaataacaccttccacctcgtaggtttgctatgcagccctggggcactcctgtgcaaagccccatgcagagctcaagcatggggtctctgggaccacactatcagggttcaaactccagctctgtcactctctggctatatgaccttgggccagtcacctaatctcttgagcctggttttctcatctgcaaaatagagataccagcacctgatacgatttggctctgtgtccctaccccaatctcatgtggaattgt

SEQ ID NO: 59752 - DNA, 818 bp, Homo sapiens
aaaaggttccggcctcagccggcgcacctggcggaggaggaacctcgcgacgcgctctcgggcatcggtttctcccagcaaagcttggagggtttagctgcgcggagagctcagcgagctcttctgtgtctgtttggggcgtgtgggctccgggagcgtgaggaccgggaagctaggaggctccttcccttctggcggctccctcactgagaccgggcggtttggttgcgggggaagtggagacgagccacccttgacctttgactgcaagaactcaccttgagcaggatagaggcacgtggacggtgaccctcgggatgcaataaatgctgagacagatcaggtgtgcaaggcacagagctagaggccagaggcctttcttctccaaccttcagtcacctctttttaaagtgaagccagcatcctcctcggggtttactgtgaaaattaagtgagctgacgcgtgctgtgttttgatgttgcttggctcctacaaacattgagtgggccagacactgttctgaaaaatacgcagtcgacttttgaacagcacaggcttgaactgcatgcggccactaatactcggacttccttctgcctctgccatccctaagacagcaagacccacccctcctgctcctcagcctactcgatgtgatgatggtgagtatgaagacctttactttatgatgatccacttccatttaatggatagtaaatatattttctcttcctatgattttcttaataccattttcttttctctagcttactttattgaaagaatacagtatctaatacatatgacatgcaaaata

SEQ ID NO: 59753 - DNA, 777 bp, Homo sapiens
aacgaattttgaagtaatctctggaatgaggaacaagcctacattattgtgtacttatgtatggtctgcaattttaaaaattttaatgattctaaaatcaacaaggctgtgtatatctcttggaaaataagacaacagtatttctcctttccagtagcagttataacagttcagccttccgatgctccactccgtcacagtgctaggaagaaattcccttctcttgggcacccagccagctgcctttctccagctgtattctaccagattggagaacacagtcattcagggcttgaaataaagttttataaaaatccaatgccccagccagagttgcagtggtgctccactttcccagcaccaaggacctactgaatagagaagacaccagggacccagagatgggtggagccacaagacagaagaaacctgggtcactgcacgactctgatgggtagaacccattccctgtccaatgcttctctctgctccccagaactgtgacatgagcaagaagtaaaccctcattatgtaaagccgctgaagtttgaaggttacttattatagctgcagcctactcagactaatacaactctccattatgagaagctaatatctacaaagaagtaatattcaacgcactccaaaagagcatacattgtaaagagattttaataagttattgcatattgctgattctgagaatacttgtttggggaaaagtaatcacaatgctatactttcaaataaatacataatcgtgattttaatgatcaa

SEQ ID NO: 59754 - DNA, 491 bp, Homo sapiens
atcgcgcgtccgcactccaatatctcaaatagcgaaaaagaacaaggcgacgcttggcagcacctactgaatagagaagacaccagggacccagagatgggtggagccacaagacagaagaaacctgggtcactgcacgactctgatgggtagaacccattccctgtccaatgcttctctctgctccccactcccaccagtgtgcatttgaactgtgacatgagcaagaagtaaaccctcattatgtaaagccgctgaagtttgaaggttacttattatagctgcagcctactcagactaatacaactctccattatgagaagctaatatctacaaagaagtaatattcaacgcactccaaaagagcatacattgtaaagagattttaataagttattgcatattgctgattctgagaatacttgtttggggaaaagtaatcacaatgctatactttcaaataaatacataatcgtgattttaatgatcaa

SEQ ID NO: 59755 - DNA, 148 bp, Homo sapiens
  misc_feature (130)..(130): n is a, c, g, or t
  misc_feature (146)..(146): n is a, c, g, or t
  misc_feature (148)..(148): n is a, c, g, or t
tttttatccttttcttaaagaattaccttttattagataccattacttttatggaccaaagtgttaatttttcatttccaccatggatatcatgatcatggttcatcctacccgtaggataattattggntattttttctttgtgntn

SEQ ID NO: 59756 - DNA, 1393 bp, Homo sapiens
attttatttaaaagcagttacccccatgggtagacactgcccagtctgacgacgttagagggagacggaggggttgacaatacagcctgtgtgtgtgtgacaaggacaggccacggtgttgtgtccggagagtttcatggggaggaaaactttaagctggaggatctgttagcctctcatgcttggccctcctcgtttcttgtagaggtgttgaacaggcaggtgtccttgtgcagaaggtgacattttttcttcggagacggtgagtttttaatgtcgagtgtgatgttggtgagtaaagggttcttgagtgaattgcagtcccagcaccctctgtggatgccaagaggaatctctgtggcgatgatttgtgagggctggtgcttacatttcagtgattaagaaatcaagtgtctgcttaaaacattactgccgtgaagcgtagattatatgatacagttgagggatggatctcaagggttaaatttgtttgaggtttgtctcctcttctggaattggttggaggctagtctcaaaaaaaaaaaaaagcaaacaaaacaacaacaataacaacgaaagttggccagaggggcctcctatgatgttgtaggaagggggtcggatttcttcatgttgagaataatgtgaaaagaaagtatttgcttaggtctcttggatcttcaactagaaatagttttgggttaaaggtagcagtggggtttgattcagcttaacaaataggcattccttgaactatttgccataaattagataaaatggaagtgtttctgttttatctcctgtactttgtggaaaggtctaatttggttttgtgaacgaatgtccgaaatgttttatatttcttcttcagactctatgctttgggaacagtgggtcacagagagggtctgagttgggaatatatggtttagagagaaaatagaggactgctgcttataagaacaggtgtttagtttgatttttgtagatattttctactggttatttaacaacattgaagtttgctttataaggtgcaaaacgtgaattttacgtagcttacacttgatctcttccttatttctctcagaaaacctgtaggattgtgcctattaaattgctttttgtgtggtttaaaccaagagagtattttagatctgcagtggttttattggaaaaaaaaaaaagtgcttgatggagctaatggtgattgtttcacttaaactaggattatatagacaatgcttcttcctgcctctttctgcgaacatttgtttttgtttctccctcaattccagggtttcatttctagaaatctgggctgcaaacagaagcagcagtttgtataatcccaagaacttgcttatgccaggaagctgtaagggtagcatga

SEQ ID NO: 59757 - DNA, 352 bp, Homo sapiens
tgaaaaccagagaaagaatcctcagaaaagagtaggtgggacaatccctaaagctcacacagggccaggaatagtttgtttgctttctcatcaatcagagtggaagaatacacagggcataatcataagaagagtattgcttctgtaatgggaccaaattagctgtacataaaaggctgccctcacaaggcttaaaagcaagcctaattagtgggggtggtggtgtatgcctgtaatcccagctaccctggagcctgaggcaggcaaatcacttgagccctggagatggaggttgcactgagacaagatcgcgccactgcactccagcctggacgacagagtgagactccat

SEQ ID NO: 59758 - DNA, 1235 bp, Homo sapiens
  misc_feature (1016)..(1016): n is a, c, g, or t
  misc_feature (1123)..(1123): n is a, c, g, or t
  misc_feature (1133)..(1133): n is a, c, g, or t
agcgggtgtctcgagtcgcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcanatgttgtgaaaattaacttgaattctgaggaggaggcccttttcaagaagagtgcagaaacactttggaatattcaaaaggatgtaatattttaaattaaagccttntaatgttccnctgtttggagaacagaagatagcaggctgtgtattttaaattttgaaagtattttcatttgatctttaaaaaataaaaacaaattggagacctgtgaaaaaa

SEQ ID NO: 59759 - DNA, 1289 bp, Homo sapiens
  misc_feature (1070)..(1070): n is a, c, g, or t
  misc_feature (1177)..(1177): n is a, c, g, or t
  misc_feature (1187)..(1187): n is a, c, g, or t
agcgggtgtctcgagtcgcacggagggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcanatgttgtgaaaattaacttgaattctgaggaggaggcccttttcaagaagagtgcagaaacactttggaatattcaaaaggatgtaatattttaaattaaagccttntaatgttccnctgtttggagaacagaagatagcaggctgtgtattttaaattttgaaagtattttcatttgatctttaaaaaataaaaacaaattggagacctgtgaaaaaa

SEQ ID NO: 59760 - DNA, 1117 bp, Homo sapiens
  misc_feature (898)..(898): n is a, c, g, or t
  misc_feature (1005)..(1005): n is a, c, g, or t
  misc_feature (1015)..(1015): n is a, c, g, or t
agcgggtgtctcgagtcgcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcanatgttgtgaaaattaacttgaattctgaggaggaggcccttttcaagaagagtgcagaaacactttggaatattcaaaaggatgtaatattttaaattaaagccttntaatgttccnctgtttggagaacagaagatagcaggctgtgtattttaaattttgaaagtattttcatttgatctttaaaaaataaaaacaaattggagacctgtgaaaaaa

SEQ ID NO: 59761 - DNA, 373 bp, Homo sapiens
ttcaaatgaaacaaaattaaacatgcccctatctagtggatgtataccttctaaatggcacatagtggcttttatacatgccttctataaacagtatgaccaggaaagcattgactttatcaggcattccctcacaattgttagggccatcagaccttcctcattccaggggatgagtttttgtcatccctggaaatcatccaatatctgactatttgtttttgacttaaaaaggggtaatgaaatggaaagaaactgaaatgggagtcagaagctaacaagttctgtgatcctgggcaggaaccttcatgcaaattgtatctttacgggcctaactttgttgacccatgcctcaatttcatcacctgcaaaa

SEQ ID NO: 59762 - DNA, 532 bp, Homo sapiens
ctcctttgtaatttgtacagaaggacttgtataacattagaaaagatagggttgaataagttacatagaaaaaatatgtcactctccatgtaactacaaagacatccataaacaggcctgagcatgccacatgcacatgtcagcacagttcacagcattcactgagcacctgctgtggccagagaccacagtagatgctgggggtgaaaagctcaaggagctctccctgtagtgagggaggcagcagaaacccacagtttcatcatagggtagttgagtttaggaataggaatgggtacgggatagtaggggattgtgagcctgagtattcagggaggacttcttggaggaggtgatgcacaagttctgtcttcagggaaagtcagtagtaaccaggtcgaaggtagtgtaaattccttttctcctttttcctctttgggatttgtatttttcccatggaattttacctgtacaggtcattttacactggactaacaatgcttaagtgctttttaaaagcaaactgtgccag

SEQ ID NO: 59763 - DNA, 629 bp, Homo sapiens
ggtaggaggtgcaggctgccaccatcacaggtgagagggcagaggctcacctgatggggacgaggcttgaggtgggctcaggctggcccccacatcacatccagccctggcgagtgtccttcaggaggtggctgtgccctcctggactcgaacatgtgtgagctgatgtaccacctaggagagcccagcctggctggccagcacctcatccaggacgacatgctctgtgctggctctgtccagggcaagaaagactcctgccagggtgactccggggggccgctggtctgccccatcaatgatacgtggatccaggccggcattgtgagctggggattcggctgtgccggcctttccggcctggtgtctacacccaggtgctaagctacacagactggattcagagaaccctggctgaatctcactcaggcatgtctggggcccgcccaggtgccccaggatcccactcaggcacctccagatcccacccagtgctgctgcttgagctgttgaccgtatgcttgcttgggtccctgtgaaccatgagccatggagtccgggatcccctttctggtaggattgatggaatctaataataaaaactgtaggttttttatgtgtattttatg

SEQ ID NO: 59764 - DNA, 5194 bp, Homo sapiens
cgcgctctcttcctccctcagacaactcgccccccgccctccgcccccctccacgtaattccgaaagagcagaagaaagagaaggagaacaggaaaagaagagctagtaagcgagagcgagagcacagaaaagaaaaaaaaaagccttaagaggaccgaaggggaggaaaggaaaaggatggacaaccacaaaacgcagcgattgcggaaattttccagcgccattggctgggcagcgtgagtccttcggtcgggcgtgatttcagcaccgggggaactggacagcacctcggggggacttctgggcaacccgcaaccacagcaagaactccaccagcagcctcaacaacagaagccgcggaaaaccctgctttgtatcagagaggcaaggtcagtccgacgcacagccatgcacaggcagtgcgcctgtactacgctgcaaaccctctgcttgtttctctaacatgcacttgcttctaattactagcattgtttcatttctgatcagtgaagatcagtagatgagattctgtaagggtgtacttttaatttatatgtatatatttaacttctttttctgttatttttaaagtgttgtgggggagtggggtttttttcctactttttttttttttttttttctttgcttgccttgcactacgtgcctggatagtttgtggatataattattgactggcgtctgggctattgcagtgcgggggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgacaaaaaacaaaaagtgctgcatggctcgcatggaatccacgcgctccagggactctgcccgcccccgcgactggagacggcatctcgttcacagcacccaccctcttacctgataagttccatcgtatcaaactttctataaacaaaatacagtataatcagaaagtgccatttcgccattatttgtgatcggtaggcagttcagagcataagttaactgtgaaaaaaatgtaaaggttttatttaggacatttgcatggctagtcatcagtccattttatgagttaacaatgtattttgttgagggaagtttttaggggttgttttgggttcttttattttgatggtgatgttttattttattttatttttttcagggggtcttttttttaatacatatccaataatgccttccatctgaatgtaaaataagtacccatgatttctattatagtatcagtgtaattatttaaaaaatgattttgaggcagttaagcatgaccaattaatgtcactctagtgcttaggctgcgatcctatggtagcaattctgtgctggtataaatcttacttataaagtaggaaaagagaaccgaggaagcacgtgaaacttactaattctattcgaggattttataatggcatattttttcagtattaaagcgaaaatgttttcaactctgggtccttacctttttccagcttcatatttgcaagtggtaaattggatttgcggtggaagagacaggggagggaaacggttggggttagatcccttcctgagctacattaaggctctttctctaatcgccttacttagctttttaccctttaagtagctcctcttccctcgcccccaccctctaccccacccccaccttcgctcagactttaccggctttccccagtccataaaggtcttgccccaacactcaccccttctttttttcccctctccaaatgcagcagtgaatccctttattaatactggaaatccctctctgctgcttttgttggtgctgcccacactgcagatatattaaggatgttaggagagatttgatttaattgactctgcctagataggtctcattaaacagagtggagatttcattggtcagcactcctcaatgaaagacagacctaatgactggcatttgagatgctgctggcattttgaattcaacatctgctgaaaacggtaaaactaattagtgcccacccaccctccccgccccagcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaaccaaaaaaaaaa

SEQ ID NO: 59765 - DNA, 400 bp, Homo sapiens
cggtactgagagcagccatcttggagcttggaaacggagacgcatgtgaagccgtttgcacagtatttttcccttaaaatatgggtggggaacaaggggctgtcatttgtctttttctttgggatggtgagcagtgagcagggcacgccgcgaggagcaaactgcagcccaagcacacgcggtcagcacgcggagcacaggtggggagaagcggctgacggtggcgtggccccgcgtacctgggtgtggacgccccgccgccccgcaggggaaagctcctggagtctggggtctgctgccccgagctctgggtgtccagcctctgcctcaactgaaatctgaagatcaggccaatttcgtggtctctcagacgtcggtaaacaagaggccttggctcctc

SEQ ID NO: 59766 - DNA, 291 bp, Homo sapiens
accctggttttcgaggctgccttgccttgcatgtcctgtaaggcctgtagacagtagacagagcgagcatcctaaacacactcatggagaaacaagcccaccagggtctctgttgtgaactggggacgtctgaggatccgtgaaatggccttgtctaagaaaacaggccctgggtgtacaaaacccagccaaaccccgcttcaacatttccatcaggttcaaatgctgagacggcaacatccctgaaacctgtaaggagatagctgcatggcccctgactcctgtttccag

SEQ ID NO: 59767 - DNA, 877 bp, Homo sapiens
accattgactaatacatgttctctgatgaactttgctattcaacatacatgcaaaggggttataaaaacaagtcaactctagtgctgatgagggtgatcatcatcactgatcatggtgtcagttgattatagtgtcaatttataacttaatttatgtaaaatagagcaatgcaaaagacatagcaatcttcacttcaaatgaagagtcttgaatgccacttttctaaagagaaggctcatggaggcacctcctcactattgaaaaatccattatacctgtgataaaactgattgtgttcagttgtattagatttgtatgcaaataaaaagttgggtaattagctatacattgtcctaaacgtataaaataagaaaaatacatagatgtatggtttcctaggacatctaccagtttagaatgcgaggctaatgtgggagctgccacagcatcctgattaaggctatggaaagaagttgcagactgatgatgtcttagaagtaatgacattttttaaagataatatttctttggtgagataaacagattatattttacagtaaacacattttatatttcagttaataagacattgtatattaaataatcgcatttaatgctttacttttttcctgtgttaaaattaatcactcatggccttggccatatgactttgccattcctcccactgtttatctgacttgtttatattttattgagcttgctcatatgacttacaatagcctgtgacagaagtgacaggagaccccatcctgaccaagaccttaagaggcatcctagtttcctctcactttcacgagcctctgcggggttcatcatgagaacatatccctagaaaccactggacaaggagaacaa

SEQ ID NO: 59768 - DNA, 489 bp, Homo sapiens
ctggaggacacaaaaaactttattttaaaatttctttacctgtcaggcaaatcacaaagataacaatagccagtcttcagagtatatcaggaaaaagcttctaatgggaattggaggcatggtgaaatacacgtggttgtattatagacacttctggcctgatctagctgaggtcagtgatggccacaaggacttgagatcacggaagtgggtgacgagcagcactttggttgtcctttgagaacagacattgctacttgaaaactcaaatctttgtccttgggaaaaaaaccaaaaaaacaaaaaacaaagaactctcaatggtggagtgaacgtagcccttcatttcagtgttggaagcaaagcccttgccctgtatcttatactttctgatgataatgatcacactgtttactggtcacaaatagtaaattgtaggctttgaatgatgtttttcaaatgtgtattaaaaatgtcctctctaatctt

SEQ ID NO: 59769 - DNA, 375 bp, Homo sapiens
gtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctttaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttataggaaaattaagatttgtggattttaaaaaagcctctcagatactacaaatgtatactttgtgcattttgggaaaaca

SEQ ID NO: 59770 - DNA, 321 bp, Homo sapiens
atttcttaaggaaactcggaggatattgtaaaatcttttcatgcttagtttaaaaatcctgttacaaacattttttcatttgtcccttctaacaaccctataaggtagacaggtggcatcttatcctgcagttgaggaaaccatggctcagagcagctccttgacacctgtagtcacaatgaatgactggctaactccaaaatcaaatctggtcctttagctcctacttcagggttttaactattgttagtgataacagtgatagtactaaaagaatgaatttctattatatgtaagaaggtataagactactttattgat

SEQ ID NO: 59771 - DNA, 7291 bp, Homo sapiens
  misc_feature (171)..(171): n is a, c, g, or t
  misc_feature (177)..(177): n is a, c, g, or t
atccggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcctangagaangggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagagaagacttggagtttattgttttttaaaaaaaccatgcttcctttggatagacttctccagcttaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaaaacttctgttcatccccaccttgctaaatttgcttgtgttgctagttttgcaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcaatctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaa

SEQ ID NO: 59772 - DNA, 7237 bp, Homo sapiens
  misc_feature (171)..(171): n is a, c, g, or t
  misc_feature (177)..(177): n is a, c, g, or t
atccggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcctangagaangggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagagaagacttggagtttattgttttttaaaaaaaccatgcttcctttggatagacttctccagcttaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcaatctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaa

SEQ ID NO: 59773 - DNA, 7428 bp, Homo sapiens
  misc_feature (171)..(171): n is a, c, g, or t
  misc_feature (177)..(177): n is a, c, g, or t
atccggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcctangagaangggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagagaagacttggagtttattgttttttaaaaaaaccatgcttcctttggatagacttctccagcttaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaaaacttctgttcatccccaccttgctaaatttgcttgtgttgctagttttgcaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcaatctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaagcattgggtatgtggatgttgtgtctttcagtaatctgagtgaactggttagactcatcagggaacttgttaaggttttaaaggttacacttcagattccagacataatgggccttatagtcatcattctaactgga

SEQ ID NO: 59774 - DNA, 3869 bp, Homo sapiens
  misc_feature (171)..(171): n is a, c, g, or t
  misc_feature (177)..(177): n is a, c, g, or t
atccggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcctangagaangggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaatcaataaactaagtcaacccttaaaa

SEQ ID NO: 59775 - DNA, 3715 bp, Homo sapiens
  misc_feature (171)..(171): n is a, c, g, or t
  misc_feature (177)..(177): n is a, c, g, or t
atccggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcctangagaangggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaatcaataaactaagtcaacccttaaaa

SEQ ID NO: 59776 - DNA, 413 bp, Homo sapiens
catgctaatatcagagtaagagtttaccctgactatttcatgttaatttttacaaacacagacatgttaatcaattccttcatgtttctctttcttcctccttaccctgcttctaaggggaatgcctctgctatgaaggctacatgaaggatccagtacataagcacctttgcattcggaacgaatgggggacaaaccaggggtaagtgagggcatgacgacttagctggttcccacatatcactgctccttacacagacatgacgtggagcaactgcatggagaggaatagagctaaagggtggctatattctgaacagcaaatgggtaaaaatgtcactatgcctttccatatttataccattccagtgacgtctatatcatctttttctccatttacgagcctctgactc

SEQ ID NO: 59777 - DNA, 662 bp, Homo sapiens
ttaattcattctacaaatatttattaaagcccaactgtgtgccagccaccaggcatagaatagggaacaaaatagtttccctgcaactatataaaaagaatggcatattgtacttaaatgcctccttgccaaaataagaggcacaggacaacagctgtctggagatgacctcaagccagtcaggccccattttaaatatagaaacccctaagaatagccgccagtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcga

SEQ ID NO: 59778 - DNA, 763 bp, Homo sapiens
ttaattcattctacaaatatttattaaagcccaactgtgtgccagccaccaggcatagaatagggaacaaaatagtttccctgcaactatataaaaagaatggcatattgtacttaaatgcctccttgccaaaataagaggcacaggacaacagctgtctggagatgacctcaagccagtcaggccccattttaaatatagaaacccctaagaatagccgccagtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggaggtgagtggggaacgggcggatccgggggctcccctaccctgcccacctgttcacaggcccgccgccccaggaccgccgcgctcaccccgctccgtccgcagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcga

SEQ ID NO: 59779 - DNA, 318 bp, Homo sapiens
ggcccctgacccggggcctcagaggcaaagccatgatggtgcggggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcga

SEQ ID NO: 59780 - DNA, 4332 bp, Homo sapiens
aaaccaataaggttaggacaagagaatagctgtggtttgcgttgcaaaaaccaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatttacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggatttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcggaaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaaaaaccctga

SEQ ID NO: 59781 - DNA, 3871 bp, Homo sapiens
  misc_feature (29)..(29): n is a, c, g, or t
tctcctttttctcttttggttaaaagagngcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatttacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggatttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcggaaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaaaaaccctga

SEQ ID NO: 59782 - DNA, 728 bp, Homo sapiens
aaaccaataaggttaggacaagagaatagctgtggtttgcgttgcaaaaaccaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtaagtacaagctgactgtttgaaaaattgtagtgactgacaacagctgtcctgtgggcaaagcccaagctaacaggagcgcttttattattgttttgatttgttttcaaagaaaaacattatggcatggggaaaattatgaca

SEQ ID NO: 59783 - DNA, 3592 bp, Homo sapiens
  misc_feature (7)..(7): n is a, c, g, or t
  misc_feature (13)..(13): n is a, c, g, or t
  misc_feature (15)..(16): n is a, c, g, or t
  misc_feature (20)..(20): n is a, c, g, or t
atgttgntgtttntnnttgnagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatttacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggatttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcggaaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaaaaaccctga

SEQ ID NO: 59784 - DNA, 3355 bp, Homo sapiens
ccatcccccaatgccacttaccagcttcaagaaccgccatctggcatcaccagccaagcagttacagatcccacagcaggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatttacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggatttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcggaaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaaaaaccctga

SEQ ID NO: 59785 - DNA, 555 bp, Homo sapiens
ccatcccccaatgccacttaccagcttcaagaaccgccatctggcatcaccagccaagcagttacagatcccacagcaggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagttaaaacagagccaatgagcagcagtgaaacagcttcaacgacagccgactgtcatctacagggggtg

SEQ ID NO: 59786 - DNA, 958 bp, Homo sapiens
aaaccaataaggttaggacaagagaatagctgtggtttgcgttgcaaaaaccaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaagtaagatgtattttctcttaatcaataaataacttctctgagtagact

SEQ ID NO: 59787 - DNA, 1572 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaaaaa

SEQ ID NO: 59788 - DNA, 441 bp, Homo sapiens
  misc_feature (45)..(45): n is a, c, g, or t
  misc_feature (50)..(50): n is a, c, g, or t
  misc_feature (55)..(55): n is a, c, g, or t
  misc_feature (57)..(57): n is a, c, g, or t
  misc_feature (64)..(64): n is a, c, g, or t
  misc_feature (68)..(68): n is a, c, g, or t
  misc_feature (87)..(87): n is a, c, g, or t
  misc_feature (94)..(94): n is a, c, g, or t
  misc_feature (104)..(104): n is a, c, g, or t
  misc_feature (115)..(115): n is a, c, g, or t
cggggggcgcccgggccgcggggtcgtttttcccgcaatccgttnaaaancctgntngggactntaancattctgaacagccccaanatgaaanacctcaaaanctaaggaaaangttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaaaaa

SEQ ID NO: 59789 - DNA, 1622 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggtgaggggtggtggcccagaggtccgacctgggaggctggggctcagagagcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaaaaa

SEQ ID NO: 59790 - DNA, 1395 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtattt

SEQ ID NO: 59791 - DNA, 879 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagagtgcgcccgaaaaccccttcccatcccgcattggtgtggcgttaggcgcacacggtg

SEQ ID NO: 59792 - DNA, 487 bp, Homo sapiens
tgcagaagttgtttctttacccttctcgtagtacaacaaaacgaaatgtcttaaatattattatttatattgtaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaaaaa

SEQ ID NO: 59793 - DNA, 336 bp, Homo sapiens
ctgccgttcttcctttctttctcttttattcttcttcacctccccttgctgttccacggcgtctttcactttggaggctggaaccttggtggagatttctgcacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattaggtctcttttattcttcttcacctccccttgctgttccacggcgtctttcactttggaggctggaaccttgg

SEQ ID NO: 59794 - DNA, 2005 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggtgaggggtggtggcccagaggtccgacctgggaggctggggctcagagagtgagtaggggagggacgggatttccaccgtcagcccctctgggttacgcatggaggaaggagttccattcagatctcactcctgctctggggaagtggcaggagtcctggacttagggtgaccaactcgttttagttttaaaacttaaggtcccgcgtcctgggaactccctcgggcctggccaaaccaggacggttggtcaccgcccgactgggcttcaggcttgctgcatgttggagacagggctcttctctgagccttgggagatcagtccctaaagaggaggccttaggatgtagcggtccagagcacatacttaggatcagaataactactgcgtgtgaatctgggttgccactacctggatgtgggatgacctggtgcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaaaaa

SEQ ID NO: 59795 - DNA, 742 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcatcgttttgttcctaatatctccttccagctcacaaaccttcaaggctcccagaaaggcacagagcctgggaagtagcactgtagaaatggcagctaatgttgttttaacatccagattccttaacctggaattaaagtcctttgttacagaccccacctcctgtccaaatgtatttcccattattttcctatatggaccctgtagcagtcagcctcttattttggaacttggcactggcagtgctacctctatgcttttgtcctgctgctcccctgcctggaatgtaaactacctggctaactcatactgctcctctgtgactctgcaaggagggcgcgcggggctc

SEQ ID NO: 59796 - DNA, 500 bp, Homo sapiens
ccatggatgcatgcaatgaaagcttttgctgagccgaatacgctgttagcacgaccgtctccccactgacgtattgcaccagacaaacaccagacgtcaaggacattgggaaagcaccaacatattcagccaggcagtgtggggatgcacccccagtcccgagatgaaaacctccagccagcccagcgcttcccagcagggagcacagaacaccatgaagcctcaagatgttgctttcctaaaacagaccagcgtggttcatggatttggggctctaagtgccccccatttcccttctcctagacctcgtccccagcatcgcgacgctattggggctggagcacccagctgggaggttaaactttcctaacctgggctcaaccttggtttcgtctctcagtcttaattttgcttcagcctggtctgtcttgctggtttatgctgtcatctaacacagggccagcaatgaagatgcttagtaaaagctgttgaaaggaaaa

SEQ ID NO: 59797 - DNA, 310 bp, Homo sapiens
gtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatga

SEQ ID NO: 59798 - DNA, 1165 bp, Homo sapiens
  misc_feature (1)..(2): n is a, c, g, or t
  misc_feature (7)..(7): n is a, c, g, or t
nncaganccaaaaacaaaaatcatatgatcagctcaatagatgcaaaaaaaaaaaaaaagctttggaggcaggcggggccgctctttgcgcactagctcgccggcgttcccaaggcccgcaggaatggccctcgcctgggggcccagctcgccaccgctagccccgcagagccagctgctgttggggcccccgcagccgccagggggcgggagaggcgtcgcgaacaatggccgcgctgggtcgcgggccggcgggaggcgtagtggagagacaagggctttagcttactttttaaagattgaagaaaaataaagaagaagaagacagaaaaagaagaactcaaagatacacaaagtaatttgaccaaggctcagaagtttttggagccgtgagggacacagcagtttggtcaatattgtcttaacatgcttcaaataaatcagcttctctccaagataaaattggcaaacccaaaagagaaaactgcaatgtatctggtaaatgagttagcccgtttcaatagagtccaaccccagtataaacttctggattaaagagggcctgctcattcaaagatgttctcagtgcaactgagtcttggtgagcagacatgggaatccgaaggcagcagtataaagaaggctcaacaggctgtcggtaataaagctttgactgaatctacgcttcccaaacctatttagaagccacccaaaagtaatgttaacaataacccaggctgtataacaccaactgtggaactgaatgggcttgctatgaaaaggggcagagcctgccatccacaggccattagatccaaagccattcccaaataatagagctaattacaactttcaagtcatgtataatcagaggtatcattgcccaatacctaagatcttttatgttcagctcatgtaggaaataatgaatttttgggggaaggaaagccagacacaatgctgcaatgaaagacatccaagcactgcagattgaacctattccagaaagatcgccttagaatggtgaatcaggaaaggatatagatgatgacagatgcaaataagcctgagatcagcttagtgtttgaaattgctctgaactgaaatatacctgttagttctgaggttattaaagaaagtggaccaccacatatgaaaagctttg

SEQ ID NO: 59799 - DNA, 258 bp, Homo sapiens
gagggctgggtgaaaaaaatactgtttcaggtaatagcaggaaatgccctcttaacttgcaggatttttatttgtatgcacaaatgaaactgctggttataatgaggctgtggggtaagaggaaggacttttcgtcttatgatggtaggaaaattacctgaggtggcaacattctgataaaagggtcaaagtaaatttgggaagaagttgtcagactcctaagatacaacacattcgggtggttcacaaggtgctttt

SEQ ID NO: 59800 - DNA, 467 bp, Homo sapiens
gaatttatgtggaatgaacaatatacaaagcaatatacttgaactgtgtttgcatggaaaatactttttttcattttctatatcctgttcaaacaactgagctattcattaaaatgatgtaataattatattagtcatttagcattgcatagataaaaccatgtaagttcaatatccattaaagttagaagattgaccacattcagctttgtaactgggggattttgcaggtacataaaaatgttaaaaggaattttaaatgaatgaaaacattccagttgaaaatggtaagaatgtgcattcagaattaaatgcactcttttccatacaatgactaaggaatacactaatgcaattgtaagtttagctactgaagcacctcttctggttcgaggacattttcccaaatctcaccacctaaaaaccccaaatttgtttcttcttctgactgaggtagttaatatttt

SEQ ID NO: 59801 - DNA, 454 bp, Homo sapiens
tatgatacatgtctcatataagggagttgtaagaattaaaggaaataatgtttataaatggcttagcatagtacccggtacagtaaacgctcgacaatgaaagctaacaaagtacagtttcaattaaggtatactctataaaaattatagactatgttagttacattgatttttcaaaatatgttgtctaattaaattaaaactttaataaattttaaataatttaaaacaacatttaaaataaagttttggattagattgattatgtacttagaatagctatttgaacctaatagaaaaataagaatattaatgtttttggctatagtcatcttatggaatcctctgtacttcttattttccttattaatatagcttgttaaacacaactttatttttcttattaatattactggttaaacacataaccattgactatcacctctattggaag

SEQ ID NO: 59802 - DNA, 688 bp, Homo sapiens
ggctagggcctccagtagtgttgaatgagagtggtgagaacacacatccttgtcttattcccaaccttaggcagaaagcgttccgtcttctaccattaagtatgatgttagctgtgggtttctttgaagacagctttattaggttgacgaagttcccttccactgcttgttcactgagagattttatttcattttttattttttcagcatttatttatgcattttaatttttttcttttcttttcttttttttttttgaaacagggtctcactctgttgcccaggctggagtccagtgatgcaatcataactcactgcagcttctaactttgggctcaagtgatcttcccacctcagcctcccatctagctgggactacagtagttcactgagagattttattatgaaaaccttttatcatagaaccatttcttaagacctcagagacctttagtttggtgtttgatagagtcttatgaatagatatcgtatgtagaagttcaaataaggtgcgttttcattaaccaaaagagtatctcagcatcccttctgggcattgttcccctgcattctcacagacagtggtccaagatagagaagggcctaagagattttagccatgacttttgtctaatgacacaaatccaataaaattaatggagataaatgggaaaaggttttttattgc

SEQ ID NO: 59803 - DNA, 396 bp, Homo sapiens
tatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcaggctgagttaaatgacccaactgatcctttcactagatatagtacaaatatttcatcaaatgtaggagaagaagttttctccaaatatattgggtggagaattgccaacactctttccaaactattctttccccccattgaggcccattttcttcctttgaagaaaccatcaataaaaaaggatcaaaca

SEQ ID NO: 59804 - DNA, 282 bp, Homo sapiens
gccctcactgtaaacaaatgaggatggaggacactgagaggatcaaatatgaaaggcagtatggggagttagagccactcgtctactcctgtaaagagcatgactactcacagtctttctagcgggtagtcactctttcatttaacaaatacttagtccctgcaatgatctaggataataactcaacagtgtatatcaagagcctttaaaaagttatacctggccgggcgcagtggctcatgtatgtaaccctagcactttgggaggccaaggcaggcagat

SEQ ID NO: 59805 - DNA, 160 bp, Homo sapiens
tgaaattaatgatttctgcttcaccagattggtagaatgtataagatggtgcatggggaagcatttaatacccaacaatatctgattacattgaatcacaatggctccctataaataagtagagttactgtttgagtctgaaaactttgaaaataacttg

SEQ ID NO: 59806 - DNA, 457 bp, Homo sapiens
ttagtccaatggggaacatcatggtcagatctcagggtcccaggccaacagttctcctattctaccaactgggcataattattcagttgctggtgacagaaaaaaatgttctgaccagaggtccctcttcaggtcacacagcactcttagtgcatcatctggggtctgggtgtccttagaaacctccccaccacacctgagtattcaccttttagcattctctaggcaaaagagggcttagttcttccattttgcagctggcaaaaccaaggcaggcagtcactgacatgtaaaaacaatgagagcccttcacaacgctcctggcacccttgcttaatctccagaaactgactcagggtataactgtatcattcagaaatcagttgatatcacagttagccagtctacccatcttcctcccacaaatacatcaagggccaaaacatagggcaaaaaa

SEQ ID NO: 59807 - DNA, 791 bp, Homo sapiens
aattgactaaaaaaatgttgtccatttatgtgaggtctcacctctgagcctgagtgagtgtttcctgtcttgaaggtcatacttgctccctctctgcaggaagttaattcagttagaagagttgcactgggagggtgcaagcacagccaacttatccagtccaagatatccagggagatgaggatgagacctgttgaattttttcttaggaaaggaaaggtcttgacagactgttcaccaactgccctagcttcctttaagcttccccatagctaccatccatcaaaacctcattgcagctgtagcctaccaaaaggcctttgggatacctgtatggttctgccagtcattcttccttaatgaaaaggcttggacatacttagtcctcaattatcctacaggtcatgtatcgactaaataaataaactgacttcattgtttctgaagatggcaaaggcgattaatggaagaagatgcagacaaactcaaaactttcagaagtctaggaggataactgagtgctattttctgtctcatgcagtttgaacatgttttctttaaaatacacataatgtaattgaattatttctatatactgttcttgagtctttcttgacctcttcttttatcccctctttcatagtcttgtttgtggaaccatctactctgcagatttttattgtctctaattatcagctctgccttcacaaattccaaatttgaaccacctaaaggggaaaaaatgcaacacacacacgcacgctcacatgcacactttgtacaaatagggc

SEQ ID NO: 59808 - DNA, 499 bp, Homo sapiens
tgagaaggccaccacggtcatttcttcccttctgtcagacataattcctcagtttggccttcccacctctatacagtctgatagcagaccggcctttattaatcaagtcagtcaagcattttttcaggctcttagtgttcagtgaaacctttatatcccttacagtcctcagtcttcaggaaaggtagaacagactaatggtcttttaaaaacacaccttaccaagctcagccaccaactgaaaaaggactggacaatacttttaccactttcccttctcagaagtcaggcctgtccttggaatgctgcaaggtacagcccatttgttgcgggaagtcagggaccccaaaacggagggaccggctgaagccatggcagaagaacgtggattgtgaagattttatggacatttattagttcccaattaatacttttgtaatttcttatgcctgtctttactgcaatctccaaatataaattgtaaagatttcatggacgc

SEQ ID NO: 59809 - DNA, 344 bp, Homo sapiens
ccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttcctgtatattctctgtactatgtcgattcgacggaacattca

SEQ ID NO: 59810 - DNA, 1256 bp, Homo sapiens
ccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaaaaacacaaaaccagagcgggggtgtgaccgagaggcgagaattccttctcaggggttagagccttctttaaataacgagttaaaacaggaggtggggggttgtcagggttgaatacgtggcccgggttgggaatcttttgattccctctaccattatctggggcaactattagtgcgcaaattaatctcatttaaattctctccaaacggtcccttttaccaattctttctggtgtgtctcataggtctctattcccttatttttaccatttttgaggaatttgggggattaaccatttgttattttccccctagaggtaatatactaaaattatcccgggaccaaattaggtgtgtaccagaaggaaccagggggttttataaaaaaaacccattgaggttgggttcccccacgtatagggtggttcacctgtgggaactagtgttaaattcagttcctgggttaggaaaccaaggtgaaagagcggtggtttaagagggtgattacctgggataaactcaggtttgggttaaagataattacttctgtataaattgggtttcctatggcgtatggccaagcagacctacaaattttgggtacggggaagcgggtaaaatgaatggaggtatattcacgggagaaattcctttgttttgaacggggctatgggtcagtcacgtgtgcactgtagagttttatcatgatgag

SEQ ID NO: 59811 - DNA, 1202 bp, Homo sapiens
ccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaaaaacacaaaaccagagcgggggtgtgaccgagaggcgagaattccttctcaggggttagagccttctttaaataacgagttaaaacaggaggtggggggttgtcagggttgaatacgtggcccgggttgggaatcttttgattccctctaccattatctggggcaactattagtgcgcaaattaatctcatttaaattctctccaaacggtcccttttaccaattctttctggtgtgtctcataggtctctattcccttatttttaccatttttgaggaatttgggggattaaccatttgttattttccccctagaggtaatatactaaaattatcccgggaccaaattaggtgtgtaccagaaggaaccagggggttttataaaaaaaacccattgaggttgggttcccccacgtatagggtggttcacctgtgggaactagtgttaaattcagttcctgggttaggaaaccaaggtgaaagagcggtggtttaagagggtgattacctgggataaactcaggtttgggttaaagataattacttctgtataaattgggtttcctatggcgtatggccaagcagacctacaaattttgggtacggggaagcgggtaaaatgaatggaggtatattcacgggagaaattcctttgttttgaacggggctatgggtcagtcacgtgtgcactgtagagttttatcatgatgag

SEQ ID NO: 59812 - DNA, 431 bp, Homo sapiens
tgatagtattgtaccaatgttaatgtcttagttttcataaatgtaccatggttatgtaagatgttaagattaggggaagctcaaggaagagtatacaagaactctctgtaccatctttacaacttttctgtatatctaaaattatttcaaaataattttttttttttttttttaaagaagaaggataagctgatcaactacagtgatggggagtgtcttcctagggaagataggggcagaagttcaagaaaaccacagagaaatagttcagaagtatttctcattcctgggctaaagagtattcattctatataaacttattaataaagaaagcagtagcagtactaccttatagttttgaaaccttcacatatatctccttgtgagcttcacaatagctgtgtgaatagattagataaggtattattagt

SEQ ID NO: 59813 - DNA, 228 bp, Homo sapiens
gggtcttcactctgaaccacccattaacaattgcttcagttgataagcaagttggtccttaccctggactgccaatgccattaggtctctgctggccctatgctgatggagacttttttaagaacagaaatgagattcatgttagttcatgttcaactatagaaaacaatgatggtgaaacattacctgctccaaattggaatttgaaacatggaaacagcagtgtgg

SEQ ID NO: 59814 - DNA, 503 bp, Homo sapiens
agctctcccagacggctctcttttccttcacattaaaaagcaaagcaaagcaagagaaactgaggcctatgttctgcaggaagtccaaagccctctccaacatctcagaggactgtttatccctgggaaaagaatagtaggatggctctcatttctccaaagtcaattctgctgtggcctctccacccttgctggcactctctggcctatcactcctacaacctcattctgagcttgacaccaccatcttctattattcctccatcactcacccaagggattgtgtggggcagagggattgcagcacagagcaggagacaagtccacattcaaggtttaacctccccattctttgaaaattattggctaggccccatctccaaggactttctgtgtcctgctgtgttcatgaggctcctctctgtacatgcgattgtcacagccttcctttttcttcattcgtcatctctcccctcctctctagagccgagtgcctcaacagg

SEQ ID NO: 59815 - DNA, 379 bp, Homo sapiens
acatatatctatatatatagacatatttctgctttactaggtgagaagagttgcttgattttaagggctctcaatcaacaggcaccaaatgaacttacagcttgcaaaaatataaagcgctcaaggccgtacagacaaaggtaagggggcacagacctttcagttgtctacaggtattatcatctgaaattgacatacgaagaaagaaggtcagagaagaaatgtgacatgcccaaggcaatccaactgaaaaaatagccaatgtggacaataatcccagtttatagcttctagtgcaatgacttttgccagcacccagcatatcagaagataaacccactgactttctttagtgaagattgcgaattgtttaaatcag

SEQ ID NO: 59816 - DNA, 532 bp, Homo sapiens
ataatcttctgtcttaagagcacccaggatgtgttttcattggtacggaattagctagccctgggaaagacagtccctccagagttagcaacaccccaagatgtcaaagataaaaatgcaaaaattaaaactccatgattaacacaactttgaagtccttctcacttgtctttagatgaagggcaacatcattgcaacaagtcacactttgagaactcaagagaatatgtttgttctgaaaatccaggaattattgccaacccatggttgtctccatatgtcttgggaaaaataggaaaaggattttttgagttggtgatttgaatccaagacacaaagattcaggctctggtaaaaagattgtataggctatattggctgacataaaaggtaagagcaagaatgcagaggatttctatcaacataaagaagagtcaaagatggagaataagagaagttaagtggttttcctaagatcacataattaagacttattaataaaaagtttgatgctctttctattataacatag

SEQ ID NO: 59817 - DNA, 596 bp, Homo sapiens
ccttggacatggctacttatcggtcattcccgaatttgaataaaggaatttagatgtgggcaacatgcacagtgctagcttggtttgccctttcctctacatttggatttactgaggaaatttagtttaacatttatcttgagttctagcaatacatagctcacaagattggggcctcttgtccttcagggtcatttcacaaggtcaggcagtctctgtttttcctccctgactcacagagtatggctccttaaacctctaccttccagggatatgaacataggtggcagatggagaccctgtgctctgcagcaaactaacttggtgggaggatgcattatggggatacttgccttttggtttcacattggtttcttgggcagcatcagcagtgcccgctttcaagaatgttggacttaaaaagaggggctgggtggggaatgatggaagaaaagttaaacagccttgttgcagataggtgttggctgcaatggttacctgctagggccaatgagtcacacacttaggtcactcatgaagacgttttaatgtaaactttaaaaagaaaagacaagttttctttaaagacttttatg

SEQ ID NO: 59818 - DNA, 422 bp, Homo sapiens
gcttaatggactcacagttccacatgtctgaggaggcttcacaatcatggtggaaggcaaaaggcacatcttacatggcagcaggcaacagagagaaagagagccaagtaaaaggggtttccctttacaaaaccatcagatctcatgagacttattcactaccacgagaatggtctgggggaaaacgcccccatgattcagttatctcccaccaggtccctcccacaacacgtgggaattatgggagctacaattcaacatcagatttgggtggggacacagccaaaccatatcagttggattacaggtgtgagccactactcctggccccaaatgtccttttaaattagtgagttttttcagtctcatggctaaaattttattttatttttgagacagggtctcactctgtcaccaaaaaa

SEQ ID NO: 59819 - DNA, 572 bp, Homo sapiens
ttgcattctctaacaatgtttggaatgcaaacttgttgtattggtagattcttggttgcaatccttggtaaaagtagcatattgtgaatttcaacaattcccaacaagtttgaaattaaacttgtcaataattgagcccattatcctccctaccacgtttcagttatttccatcaccaccatcctccagtatttcaggtccaggacattaaaattatttctgacacctcttctgttgcccacttgcagtctgttactgattcttactgactgaccacattttattctcttgacacagtatcatctgaaactctgaagtagattaatcaacttgtattcctctgttctctaaacaatctaaccttaaaaagtaagaattatcttaaagcatcttcttaaagactatgctcagaaatttaaggttactttcaattgcctgcaacttgtatccccagcaatgatctttattaattctcaaacattgtgagagccaagtaaaccagatttctgttccatgctcacctctgcctgtttctacttgccctcctctgtccgtaatcaacttatttttct

SEQ ID NO: 59820 - DNA, 423 bp, Homo sapiens
agtacactgtagctggtaagaactaaattaaatttgatcacatgacattgtttactctgtgcattaagttttcttgaagttttaaggttgggaactcccacagggttaccttccaggaagtcctcctgggacaagcatgtcctataaatgccagcttactgatataaaaatctctcatatttgaaaacgcattctaattaacttttaagaacaagttgcaataaagattgtttatacttacacataaccatttggtgtaattggtagaaaaatcctatttgacatcctcacattgcttaaaattctctctgctgtttaaattgctttaaaaattgttttatgcctcatttaatataaattaaataagggtactggatgtccaattactgctcaataaaaatatttgtttttattttaaatgtg

SEQ ID NO: 59821 - DNA, 2892 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgta

SEQ ID NO: 59822 - DNA, 802 bp, Homo sapiens
cgcggaatagtacggggcaggagaagaagaaggttctaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59823 - DNA, 950 bp, Homo sapiens
  misc_feature (807)..(807): n is a, c, g, or t
  misc_feature (812)..(812): n is a, c, g, or t
  misc_feature (819)..(819): n is a, c, g, or t
cgcggaatagtacggggcaggagaagaagaaggttctaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattaaaanaaaanggctttntggcctagggggaaatcttcgcatttccttaagagggtaatcatgagactgtcactgaatcatgccctggtgctcggtgggcgacgtctattccctaaggcgacacggattccagatacgggaaacaaaag

SEQ ID NO: 59824 - DNA, 642 bp, Homo sapiens
  misc_feature (36)..(36): n is a, c, g, or t
accgaaagagagcccccccgccgctgccactcactncctctggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgta

SEQ ID NO: 59825 - DNA, 636 bp, Homo sapiens
accacgtctgcgcttcgctaaaaaaagaaggtccttgtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgta

SEQ ID NO: 59826 - DNA, 324 bp, Homo sapiens
tttttttttgggggggtttttttttcccccttttgggaaaaattaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59827 - DNA, 1096 bp, Homo sapiens
tacagatgtaatttcttttcagaccttatctttttattaagaaaaaaaagtattgtaattgactttaggttgccattgaatctgacaaagttgggtaaaaatgtaaaatgtttaagagaactgtaatttcagaaactacattaaaataaaaatgttacattaaattttgaaaagtaattttatgtacctaaccgcattaagctggagactaaaagtcttacagaaaattcacttataagtagatctaatatatacaaacgaacactttgtagtatgtataggtaccatggttttacttaaaacctgagccacaacactgtttctctatttgtgctatgagggtagcaagtggctggtgagctttgtatactccactaaacaatttttgagactgttcttggctcacagttaggtacagcaaaattgtaacatgttcaaaaaaatatagtgttctgaaatactcatttttggtttaataaccagactattaagaaagacaaaaaataatgtacttgtagcagcatctaggtattatttaaatgtaacatgtgtgctaattcttgcaggcctacgtgagtgaaaaacatgaaggcaataagatcattgcttttgaaagagcaggtcttcttttcattttcaacttccatccaagcaagagctacactgactaccgagttggaacagcattgccagggaaatatcctttttgttaccagtgaatatgactgtccacattcacttctttattacattataggacaaaaaaaaaaaaaagactaaggttgatcttgatgacagaaacattcattttcctcatctgaaaaatgaggaacttaaaatagttgatggataaatctttgctcgactcagttatactgaattattcctaagcttcattttgggtttaaacagaggggttagtgcagacgtggttcacatcaaaggaaagagctgtggatcttgctgtcctgaaggtttcactatggagccctgctctccaggtccccacatccaccaatacagaagacaataaatgaagtcttctgagataatagcagaggctctggacttaggggaccaggctttaaaaagtata

SEQ ID NO: 59828 - DNA, 3192 bp, Homo sapiens
  misc_feature (3081)..(3082): n is a, c, g, or t
  misc_feature (3086)..(3086): n is a, c, g, or t
  misc_feature (3091)..(3091): n is a, c, g, or t
  misc_feature (3095)..(3095): n is a, c, g, or t
  misc_feature (3100)..(3100): n is a, c, g, or t
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattaaaaaaaaaaaaatggctcgttggcnnaggnggaantttnggccnttcctttaggagagtaattatgacctcgtcactaccgctggctggtgtcggtgtgcagcgtttattattaaggcgtatctggtaccaatatg

SEQ ID NO: 59829 - DNA, 1578 bp, Homo sapiens
tacagatgtaatttcttttcagaccttatctttttattaagaaaaaaaagtattgtaattgactttaggttgccattgaatctgacaaagttgggtaaaaatgtaaaatgtttaagagaactgtaatttcagaaactacattaaaataaaaatgttacattaaattttgaaaagtaattttatgtacctaaccgcattaagctggagactaaaagtcttacagaaaattcacttataagtagatctaatatatacaaacgaacactttgtagtatgtataggtaccatggttttacttaaaacctgagccacaacactgtttctctatttgtgctatgagggtagcaagtggctggtgagctttgtatactccactaaacaatttttgagactgttcttggctcacagttaggtacagcaaaattgtaacatgttcaaaaaaatatagtgttctgaaatactcatttttggtttaataaccagactattaagaaagacaaaaaataatgtacttgtagcagcatctaggtattatttaaatgtaacatgtgtgctaattcttgcaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59830 - DNA, 2927 bp, Homo sapiens
  misc_feature (2903)..(2903): n is a, c, g, or t
  misc_feature (2913)..(2913): n is a, c, g, or t
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtaaaaaaaaaaanaatggcctcnttgccctcagaggg

SEQ ID NO: 59831 - DNA, 800 bp, Homo sapiens
tatttattatttttaaatctatccgcggtaccctcaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59832 - DNA, 801 bp, Homo sapiens
aatatacgataatttctaataacacagtgtgccttcaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59833 - DNA, 806 bp, Homo sapiens
cgaggtctcgcgggtcgcgggcaattaggtagggggcgtgctggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59834 - DNA, 802 bp, Homo sapiens
aacccgcgccggaaataggaaggaaggggggggcttagagtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59835 - DNA, 806 bp, Homo sapiens
gattagtcgaactattaatatatcacgagaaggaaagcccttagtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59836 - DNA, 803 bp, Homo sapiens
atatccgctataatattataaaatgattaagataacttcagtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59837 - DNA, 805 bp, Homo sapiens
  misc_feature (23)..(23): n is a, c, g, or t
gtgtcgacaggcacattgagatncccaccacccattgtcaaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59838 - DNA, 806 bp, Homo sapiens
ggcggggccgcgcggcagaggcagcccgaccgggcgcttccaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59839 - DNA, 803 bp, Homo sapiens
gtcgttacggccccctaattagcaacggagccgggtctaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59840 - DNA, 808 bp, Homo sapiens
  misc_feature (27)..(27): n is a, c, g, or t
tattttcacataagtcttacataccanccaaaagagccccttcaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59841 - DNA, 871 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaagaacttccagaactcgggacaactcagctattaaaggattaacagctggcaaatactctgtggccatcatctcatctgattggtagaaacaaaaaatatacatgttgttaaaatatgttgggtttatgtgtacatatatcaaaacattgttttacaccttgaatatatacaatttttgttaattataactcaataaagcacga

SEQ ID NO: 59842 - DNA, 777 bp, Homo sapiens
catctaaatgaagtagtaacattgcaaactgtggggcagccttccttcaccacctaatacagcctcaacatggcagtaacagggccattcacgtcattcttgtgtaaggagcattggttttcattaagtcgtatggcgccctctagtggtggttgctttatggtagtcatgttgctgccagaactgttggaactgtgaaattgagccttctaagagcttgtaaaattgtaaaggtaactgtaactttaggcagatgtgagactgcgtcatgcctatgtttctttgacataatgacaggccgtttggtactttcttcaattgcactgacataattgttttgacgtaggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaa

SEQ ID NO: 59843 - DNA, 3055 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59844 - DNA, 2641 bp, Homo sapiens
cccagcctacatctttctcccatgctggatgcttaaagcccgtcgaacgtcagactccaaattcttcagttctgggacttggagtggctctccttgctcctcagcttgcagacggcctatcgtggaaccttgccattgcatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59845 - DNA, 2997 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaacacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59846 - DNA, 1377 bp, Homo sapiens
ctcgtgccgaattcggcacgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59847 - DNA, 3000 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtaagtaagtttctcaacatatttcctatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaatt

SEQ ID NO: 59848 - DNA, 1717 bp, Homo sapiens
cgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggtaaatgaatatgtgcataaattcatttatt

SEQ ID NO: 59849 - DNA, 2181 bp, Homo sapiens
ccatcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 59850 - DNA, 1241 bp, Homo sapiens
taggctagacaggccggtggttagcggcgagggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 59851 - DNA, 1423 bp, Homo sapiens
ccatcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccaggcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 59852 - DNA, 2220 bp, Homo sapiens
ttggagcgcgcggagctcggctgccagagagccgcgcgggggacgcgccgggaccgcgaggagcgcaggagccttcgaggcggtgaacgagggagggagcccagtccgccgcgggccatgagccaccgggcccggggagcccggccgcggtccgggcagcgctcagccggcgccccagcccgctcggccgcagctgcgcgcctgtatgccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 59853 - DNA, 952 bp, Homo sapiens
attctctttccttttttaaaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagcactcgctctgcaaaaaat

SEQ ID NO: 59854 - DNA, 871 bp, Homo sapiens
attctctttccttttttaaaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaaggcatccactgcgcaaaaaggattgtgtccggagcacgggggatgaacaactggtgaggaggacacggtgggactcagcgggcagagccccacgaaggaggacgtgacagagaaaagggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcc

SEQ ID NO: 59855 - DNA, 834 bp, Homo sapiens
attctctttccttttttaaaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcc

SEQ ID NO: 59856 - DNA, 443 bp, Homo sapiens
tgctccatatgcgagactcaccaagaactgggtcatgtgtgtggaagagttactgagtgtgaggcaagaaccatgtcttttttctccgcagggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagcactcgctctgcaaaaaat

SEQ ID NO: 59857 - DNA, 796 bp, Homo sapiens
ggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactcttta

SEQ ID NO: 59858 - DNA, 422 bp, Homo sapiens
gaagaggacgttatttaaacattgtaggggtgaagtatgatttatgatactgatgggaaaacacataataatggaaaatttcaaagtgttttatatctagtataataagtaatatgttttccttttaaatgcttgaaaataaagaggcgttggggcatggtggctcaagcctgtaatcccagcactttgggaggccgaggcgggtggatcacctgaggtcaggagttcgagaccagcctggccaacatggtgaaaccccatctctactaaaatacaaaaatgagctgagtgtagaggcaggtgcctataatccccactactctcgaggctgaggcaggagaatctcttgaacccggggggcggagtgaagtaagcgccacttcactccggcctggatgaaagagcgaaactccgtctcaaaa

SEQ ID NO: 59859 - DNA, 309 bp, Homo sapiens
tctcctacatatgaaaaaaatctctattgtatatgtataattattttttatcttaaatttactaccctgcagtacatttttatttataataactgctataagtaattttcaatttggattcttttaacagtctagacttagttctacaaacttattaaacaatctttcaaacttatttggataatagaaaaatatgttaaatggtaccatagtgaaaaatgaatactacctagtttatctttttaatgagtttctactctctctaagtcaaattcgatagtgatacattagtcaatgtatctagtatag

SEQ ID NO: 59860 - DNA, 275 bp, Homo sapiens
taataagccagttctaaaatttatatactagactaaaaggacaagaatagccaagtcactcctgaaaaagaagagcaggaaggtaagatttcccctacaaataggaggacttattatgaagcttacagcactttagaaagcataggagaacaactgaattgttcagtggaataaaattcagccaccatgcccagcctagacttggttcttttggttttatggtaaagtagaaccttgaaggaagttccatctgattaatgactagttaaatgttt

SEQ ID NO: 59861 - DNA, 669 bp, Homo sapiens
ttttttttttaaaaaggagaatctctaatgtggaatttcaaacagtgaatagataaagaagctatttggaggaaatccaaaggcatttctcagctgctgaactgaaatatctagggcccattccacccacgggtaaagctgaccctgagagaaccttttataatagagccatgagttttaatcttaagataggtgcctattaattctgaatattcagttttaaaagaactagaaaaccacactaatgcttagagaaaagctaataatgcttcccatttctcccaagaactatttctaccagctcattcccagggggatatagaggagtaggggcatttcttccaccagttaaatatctttgcaaaagaaaatcatgttacattcacctaagggatttaatcccaagaactttttcccctaaatttaatatgcgaattgctcccaacttgagagaactaggatttgtagatactaaagaagcaaatcagaaattaagctgcttggatttaccagttattgatctggtattattccctggggaaactactcaaacattttcttgctcactctcaccttctatagaaaataaaagtgctaaaaaatttttcttacagatttttctaagtggctgtacatttcccttaaaaatctttgaaagataaagctact

SEQ ID NO: 59862 - DNA, 731 bp, Homo sapiens
gggtagtggacaaatgatagtattatagttttcactatgctcatctttaaataacaatcttggggtagtgtaaaggacacacaattatcgtgacttctgtttgacccataagagaaatgcatattcgggttgtacttttctcaaatgactacaaccaccaatactttacataactcttgactttttagggcagggcatttagctttaaaatactcccattgagggaaaaataatatttaccctaatttcctccctctgtcccttttcgcttctatctaaccaatctgcgtgcttttatgtattttttttttttttttggaacttattttctatctggaatgcttatctaaacaaagagttagatggccttgataagtgagactaatggaatcgtttccctctaacttcataaaaactttaaggattatctttcttgagttctctgtatttctgttttagaagaaaagaacaaaatttcagaaacaagattatagtgcttttgctaaagtataaatacgtgggccctatacaaactggcaaattcattagtcttaaagcagacatccaagctattgtgggtgtttggatgacaccattttcacagtaggaaatcatttcattctgagcgtggactcggcattggttaacgcagtgagttttatgtggtataaacacctggaagtgagagaaaagacagcacagaagctctgtgggagctctgctgagcattg

SEQ ID NO: 59863 - DNA, 212 bp, Homo sapiens
cccggcctgaagttgtcggtcgcccttttgacttgcagcagggcgggcagagcgacttagaggaaaagtgactttttgtaccctcctgcagggagcaggttctctgtccttgtttaattagacatttctcagagaatcctgcctctgctctgaagcctttctgttcgctccagtgaaaattagtcatccaccgggcgcggtggctcacgcct

SEQ ID NO: 59864 - DNA, 421 bp, Homo sapiens
gcactaactaaacatggtgataccatctactgacatggggtgactggaagaaacacggtggcaaagaggaaaaggaaaaaaataaaaagaaaaatcaagcttatcctctctcatcctagtcaactcttaacctacccttcaaagctcaacttagatattaactcctccaagacgccttcccagatccccagactagtttaggaaagatattcaagtactaccattgtattttgtacatatccctatcactgccttcccatattgttttacaattatctgtttacaattttcttcctaactagctaatagtcctcttttgttacggaaggtgtcttgttcattttgatattatcaggacgtaacacaaaacaggtactcggtaaatatttctgaatttaataaatcaattagcataaactta

SEQ ID NO: 59865 - DNA, 1307 bp, Homo sapiens
ggaataagggctgtcactagctgtctggtatcttgccctggggtgattacagcaggtggatagtggcctggagtgtgagaatctgataaaggaggtagttggaatatggtttatatcagttggtttgcattcgaaaagtgcatttgtgggcaagttgctgtatctctaggagaggcaggccctccaggattagcaaaacctcagatgttaaagcatgcagaaaataaaagacatggttcaaatagttccctaacaagcagttgtgcaatgctgctctgaatggaaatccaacctcacagtttcccatctagaaagaattttaaactctctattctgtcttccacatacacgttccctcccactgttatagcatctgagaatctgcttgagctctggatcttcatccaatctcctgattaagatttcaaactggccaggtgcagtggctcacacctgtaatcccagcactttgggaggctgaggcatgtggattgctcgaggccaggagtttgagaccagcctggacaacatggcgaaaccccgtctctacgaaacatacacaaattagttgggtgtggtggcggcgagtgcctgcagtcccagctacttgggaggctgaggtgggagaatctgtggaacccaggaggcggaggttgcagtgagttgagattgcaccactgcactccagcctgggaaacagagcaagaccctgtcttaaaaaaaaaaaattcagactgagcctcacagtgggacactaggtcggtgtcagcccacagtcctactagagtgctgtcctgcgatcaggcctctttgggtctggctatgctgtcagctgagattctgcccaggatcctgtcactcacatgttgtcccagcttgttctcaatgtggcagccccaaatgacagccaaagttcttccctaattgcctactttacaggaatcctgtccaaaaatggaaacacgggcattcagcagcccttgctctccctcagcccctcccctgacagccactgatctgttcttcatccctacacttttgattttttccagagtgtcatataaatggaatcgtgcaatatttagccttttgattctggctttctttagtcagcataatgcctctgagattcattcactttgttgcatgtgttaatatttagttgcttttcgttgctgagtaatataccactgtatggatggaccacactgtgtttatcccttcccctgttaaaggctggttgagtcgcttccagtttgggggcgattatgaataaagctgttgtaagcattcgtgtacaggttttt

SEQ ID NO: 59866 - DNA, 1153 bp, Homo sapiens
  misc_feature (458)..(458): n is a, c, g, or t
ggcattgccagatcagcattgggtggaggcagggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccaggtccccacacaaccctcacccctggctgtgagaatcctgaggcaccttgatgcattttttttcatgccctgtgacaggtgctttgtgctgccagctcacttaaaggggcagagttctaggaacaaaataggggaaaagcacagccccgcctcgacagcaggccccaggtagggggcgatgtggagggaggcccgcctcaggaggagcccccggggtgggggggtgaagcagagggaggccacccctagcaaaggctggcagttcagggnacggcccccaggggccttggcactttattttttattacttgttttttttttttgagattgcaccactgcactccagcctgggaaacagagcaagaccctgtcttaaaaaaaaaaaattcagactgagcctcacagtgggacactaggtcggtgtcagcccacagtcctactagagtgctgtcctgcgatcaggcctctttgggtctggctatgctgtcagctgagattctgcccaggatcctgtcactcacatgttgtcccagcttgttctcaatgtggcagccccaaatgacagccaaagttcttccctaattgcctactttacaggaatcctgtccaaaaatggaaacacgggcattcagcagcccttgctctccctcagcccctcccctgacagccactgatctgttcttcatccctacacttttgattttttccagagtgtcatataaatggaatcgtgcaatatttagccttttgattctggctttctttagtcagcataatgcctctgagattcattcactttgttgcatgtgttaatatttagttgcttttcgttgctgagtaatataccactgtatggatggaccacactgtgtttatcccttcccctgttaaaggctggttgagtcgcttccagtttgggggcgattatgaataaagctgttgtaagcattcgtgtacaggttttt

SEQ ID NO: 59867 - DNA, 922 bp, Homo sapiens
agtagagaggtgctgaagcccatcatcatgagtgcttgtgacctgggcacacacaccatcatacacacacctcctacatagacccctcttctaccgggacagggagccaaattgattagtgtctatcactgcaggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctggtcacggctcaacatatttctggcattcttttgaaaattactttcctgttggcccattgctatcttattaaatcaatctctctctcaaa

SEQ ID NO: 59868 - DNA, 834 bp, Homo sapiens
tccaggatcagaagtactgaggagcagagccaatcttctctgtttggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctggtcacggctcaacatatttctggcattcttttgaaaattactttcctgttggcccattgctatcttattaaatcaatctctctctcaaa

SEQ ID NO: 59869 - DNA, 432 bp, Homo sapiens
tgctaagtacagcggtcaggaggagggaagctgaccttgaatcagcaccttagtagaattccctgattgatatgctttgcgtccccctcccttatcagccctctgaacgtatctctaacacagcaggaaccatcgctgtgtttcctgtcagtctccccagctggtatgagaactatccaagagcagaagccttatctaatttgtatttctctccagagcacctaccacagtacctggcacatagctgtttgatcaaagcttgctacactgaactaaactgcagtccagatcctttggataatttatgcaagatcacaaagctaagaggtaaaaccggctcaggacccagagctctgactcattcattctcctgcactggtgactgttgatttttcctagaggagactagctctggaggtgcaagcagtcatc

SEQ ID NO: 59870 - DNA, 372 bp, Homo sapiens
gcagtgatactgaaatgtaactggacaggtcagagaaaacttccttgataaggtgacatataaactgaatattcatgggcttgaacatataaaagtggaaggagggggatttcaggaggggcagagtgagaaaaagaaaaatgaaaaagaaagaggcagaaaaacttagtgcacattttagtttgtcactagggtttttggaggttcaaggtgagattttgattattgaatcctccacctacccctcctgccttctgggattctggactgatgcattatttataaaaatgtatagaagccaacagggaaataaagtactgtttaaaaggtggacaaaggctggatagccctcaatgtctgactttttcaatg

SEQ ID NO: 59871 - DNA, 1335 bp, Homo sapiens
ccacgaggctgcttgagcttcctgggtcctgctccttggcagccaatggagttgcaggatcagtcttggaaccttactgttttgggcccaaagactcctaagaggccagagttggaggaccttaaattttcagatctatgtacttcaaaatgttagattgaattttaaaacctcagagtcacagactgggcttcccagaatcttgtaaccattaacttttacgtctgtagtacacagagccacaggacttcagaacttggaaaatatgaagtttagacttttacaatcagttgtaaaagaatgcaaattctttgaatcagccatataacaataaggccatttaaaagtattaatttaggcgggccgcggtggctcacgcctgtaatcctagcactttgggaggccaaggcaggtggatcatgaggtcaggagatcgagaccatcctggctaacacggtgaaaccccgtctctactaaaaatacaaaaaaattagccgggcatggtggcgggcgcttgcggtcccagctacttgggaggcgaggcaggagaatggcatgaacccgggaggcggagcttgcagtgagccgagatcatgccactgcactccagcctgggcgacagagcaagactccgtctcaaaaaaaaaaaaaaaaaagtatttatttaggccgggtgtggtggctcacgcctgtaattccagtgctttgggaggatgaggtgggtggatcccctgaggtcaggagttcgagaccagcctgaccaacgtggagaaacctcatctctactaaaaaacaaaattagccaggcgtggtggcatatacctgtaatcccagctactcaggaggctgaggcaggagaatcagaacccaggagggggaggttgtggtgagctgagatcgtgccattgcattccagcctgggcaacaagagtgaaacttcatctcaaaaaaaaaaaaaaaaaagtactaatttacaggctgggcatggtggctcacgcttggaatcccagcactttgggaggctgaagtggacggattgcttcagcccaggagttcaagaccagcctgagcaacataatgagaccctgtctctacaaaaaattgaaaaaatcgtgccaggcatggtggtctgtgcctgcagtcctagctactcaggagtctgaagtaggagaatcacttgagcctggagtttgaggcttcagtgagccatgatagattccagcctaggcaacaaagtgagacctggtctcaacaaaagtattaattacacaaataatgcattgcttatcacaagtaaattagaaaatacagataaggaaaaggaagttgatatct

SEQ ID NO: 59872 - DNA, 413 bp, Homo sapiens
cttaaattgaagtatgttaaaacaagccccaggcattgtgtcatttcttctcttcatacctcaagatgcatcttgtagcaacacccgacctgtgtttaaaggagtgtgacattgcaggcagagccccctccacccaccctataccaggagcatagcatatctgcctgggtgccctggcaggcacctgtgtgttgtactctggcaccaggtgtgggttctcaatcatcctggctggaaaacacatttttggctccttctaaaccctctgaccattcaggtgttgatttaattcagttccagcttgtcagttgctgctgagtgccgccttgcctgctttaatgactgtcaggaaaggaggtagagaagctgcctccaggagagttactcaattcctgattcaccagtagaactgt

SEQ ID NO: 59873 - DNA, 411 bp, Homo sapiens
taatcattgaagaggctactccaaccaccaaatacaatatctgacttaataagctgggtgggtttttttcatatagtcacacaagtaacacataaatattcccatggaaaacccagattacagacaaatgaaatctcccttcaccccactccactctcaatgcaatccaagttatttcccagtgttggaagtatgctgtgtgtccttccagatctagcccctctcccttcttattaatttgtttctacttgttgcttttgaaacaatgttatgatgtggggtggggtggggggtgtcttggcagttttgtaagataaaattcctagaaattggatcacttagccaaacagcattaacatttaaattttaaatttccctccagaaaggctaaactaaattctaatcccacac

SEQ ID NO: 59874 - DNA, 258 bp, Homo sapiens
ataaatagtatttgtgaaaaatgcaaaagaatatgaagaaaaaggatatcaaaatcctgctattaacatttcactgtgcgccctttaacgcttcacataattgaagtgaaattgtatcagtttgtgtcctgcttgtgttattctgaaagcattttctgtgttactaaatttttctcaaaaacatttcttttaatggttgcatagtgttttgggtcatggaataccacagcataatatatttttcactataataaataa

SEQ ID NO: 59875 - DNA, 1024 bp, Homo sapiens
caggagaagagaaccttgcaggaacaatgaggaggatttggatttccaagcccttcctggagccctctgtccactaggccaagagtctgcctggatctccatgagtctccagggataacacagaggctggcgcacagtgagtgcttgatataggtctactagcagatggcctctgccatgctcccagtgagagtgctcccaccagcctccaccttcacctatggtggtgagggagggatccccctctttatgccttcggctcagggaaatggggtggcttttccaaatgcatgagctgttaggctttaggacttggtccccagctcccctgaacggccagtggtgctcctgggccagaggcaggatgggggcacatagagtaaggctcacctgtgaccttctcaggtgaatgtacaagcaaatgccagcatttgcaacccatgggctggctgacacaattaatccttttaagacctgccaagagttagaggactcattcatttattttcttctaatagcgttgcgttaaatgaaagaaagaaaaagaaaaaagaatatacatgctcattgtgggcaaaccctgttgttacagaaaaggagaaagagtaaagcaaatccctagatttgctgatctaccactaccatctagagagagccacgatgaacagccttctaaatcttcttctgttcataaatacaaagcagttaaatgtagcaccattttatatagacagtattacgagatttaggctgttctataacctgctttttttcacttaacaacttgtcatgacaccgttacctgtcagttaccacagatctgtaccatttttaatagccccacggtacagttttgcatggatgtggccgtaagttacccaccagttctgttgccagaaatgtggattgttttccatttttctctgcaatgtgctagggaatatcattcagctttttcagatatgtaataatcgtctagcagtaaatatttagaatagctgggatagctagggcaaaaaaaaaa

SEQ ID NO: 59876 - DNA, 761 bp, Homo sapiens
acagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatac

SEQ ID NO: 59877 - DNA, 465 bp, Homo sapiens
attcatttagctccgttggtaaaagtaacttagtaataatgctggaattgtaaggaaaattatggtttactataaatgtctttttgaagttatattgtaggtaatcattaagacctaattattagatgatactaatctttaaagtgaccagttttcttacaatttagtttcttgagttcttcaagggaatttaattgttgagcaccattatctatagacacatatactcttacatattgtgctatattatgtagattcagccataaatagtgcttaatcttattaatataaatgtatgcgattcctgtaaaattaatgacacaattattaaactgctatagatgggcatgtatatgtttataaataccatgctatattatgtaggtccatctatatagtgttatgaaaatttcatacatccaaaaaagttaaagatgcatcgccagatgcttcctttggccaaaa

SEQ ID NO: 59878 - DNA, 824 bp, Homo sapiens
  misc_feature (30)..(30): n is a, c, g, or t
  misc_feature (62)..(62): n is a, c, g, or t
aaagaaaaagggggcccggattaacccaanccgaaaaaaaccttaaaacccatggattaatnaaccacgcccacaagaagaacaacaaggggaaaaaggggcccgggaaaacccccaaattgaaaaaaacctgggcagccagtgagtggctgatcatgagtactcaggaaatgcacattaaattcaacagggagaaatcctctctgcccctcagactgcccatcaggcttgggaggtgtcgggagacaggcgttcatcctggtcgctgctttgggtagcagcttgcagtgctgaaacagtcaaagatggctgtccctcagccctgccacctcccattcaagcgcctgctctgaaagctcctgagcagatgggcctgagatgcagacaggggtgctcgtggcagcaccatttacaatgatgcgaaaacagaacccgcctaactccccgtcagccaggaggaggtgggaaaccaacacagcgcatggttatttcatatgcggggatacagcgaagatggacgaagatctacacgcaccagtgcggatagccctcgaggacatgacgttgagtgaaaaaagaaaattgcaaaaggatatgtagagtatgatgccaattatgctatttctccaaaacacaaaaagcaatgatgacgaattcatagttatgtagtaaaaatacagaagccatgcatgggaataaaaaaacaggtctcagtcatgagacagagggaccgaggatgggagcccctgggggcagtcctggcaggattccaggaggaggtgcctttgcatgacgggagctggggtggtgggtccaacagctgt

SEQ ID NO: 59879 - DNA, 231 bp, Homo sapiens
ggtgccttatttagttcatttggtgaggtcatgttttcctgaatgctcttgatgcttgtggatattcattggtgtttgggcattgaagagttaggtcttttatgtagtttttgcagtctgtgattgtttctgcccatctttcttcagaaggccttccaggtgtttaaagggactttggcctccagcccgaaaatgctgtggttcttgcacattcttagaggtaccgccatg

SEQ ID NO: 59880 - DNA, 2746 bp, Homo sapiens
  misc_feature (171)..(172): n is a, c, g, or t
  misc_feature (849)..(849): n is a, c, g, or t
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctnntgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactntggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggtacgcttgctctcggggtggccttggggtgctggtggggcaggctggcgggtggcggctccctctgaagggtgcattgctctggaacgccttgtttgtggacatgaagtatgaattctgtgcagctaccacgtgcatgagatgtgattcttgtgtttctttttgacaatttaggaatgtaaaacccattccaggctcatgcagcatgggctgaggtgggtgggccgaggtgggcggccactggccagtgggtctctggctccggtgtctcagctcctctccctcccttggagacacgagggcaggacacagcttgggtcccctccgtgagcctccatggggcgctgcttgtccctgccaagctgggggctgggagtcctcggccctcgaggtcctcacaaacccagcagcttcacaagcaggacacgagtgcctgggtgggccgcatcttttctccttttacctggtgatttcaagtagtgtcaggtttgcggaggagttacgaggaccggacggggctccctggtgaggtggtcctgtgtacctgcggacgctagctctggcccagcacctccaggcagggtctgcttttccgccctgcccttttcgtcttcctcactggtccaggattgcgtggccctcagccctctgtctccttagccctctcccgtctgtgactgtcccctcgtctctctgggttcttggtggtctgagggtctggccaggctcctgcaggacgtcctctgttggggcttgtctggtggtttcttgtggttgaagtcctacagttttggcaggaatgcagggagatgccgtggggcctgccaggagcgtcctgtcacaggcgccgtctgccaccctctccactgtgacgccactgcctttcctcctgtgactgatcagtgccttcgagagatactttaaattctttttatttttagagacagggcattgctctgtcacccaggctggagtgcagtggtgcgatcttggctcactgcaagctccgcctcccaagttcatgccattctcctgtctcaacctcccgagtagctgggaccacaggcgcccgtcaccacaccaggctaattttttgtacttttagtagagatggggtttcaccgtgttagccagtatggtcttgatatcctgacctcgtgatccgcctgcctcggcctcctaaattgctgggattacaggcgtgagccaccacgcctggcctaatttt

SEQ ID NO: 59881 - DNA, 2086 bp, Homo sapiens
  misc_feature (171)..(172): n is a, c, g, or t
  misc_feature (849)..(849): n is a, c, g, or t
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctnntgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactntggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagtgagtttgtgtcctgccccagggcccatgctggccgctgcctgtcccccagccagccccctacatagaacatcgcctgccaggagccgtgaggaggggactcaggtcacaggggccttgtggtgctctcctttccccatgatgctgggtctggggccttgtggtgctctcctctccccatgatgctggggctggggggatctgtcatcaccctccctccccatcc

SEQ ID NO: 59882 - DNA, 3181 bp, Homo sapiens
  misc_feature (171)..(172): n is a, c, g, or t
  misc_feature (849)..(849): n is a, c, g, or t
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctnntgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactntggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaaaaaaaaaaggttcctaagcctcgagggcaatgaagggtgacacgcggagttgcccacatttggccggccgcgatagtgtgacaccacgcgggtcgtccggggggtccacccccggcggacaatggcggtgaccgcggggccgaggccccaaaacctttggcgcggaagaggaaagggtcccaccgtgtacgccacagg

SEQ ID NO: 59883 - DNA, 690 bp, Homo sapiens
tgtgagtgtgagcacatgggcgagagtgaggatgcatgttcatgtactgggaaaggcgggctggcggcaccactctggcttagttctcattttaactctgaaagtcagaggtcatgtttcatgaagcctgagagcttcacggagctccagcctacctggccaccctgtggtccatcttcctggaagccccgcccacctttctcccttgcgggaaccccgcctgtgtcaggatgtttttccagatttgttttctttgttaaagcacgttcttttgcagctttctaagaaaaggttttgcaggaggtaatttttggggtcttgtgcccctgttctgtccttggatcatttagccgggtatagcatgcaccattatgcccggctaattttattttgtttgtttttttgagagagtcttgctctgtcgcccaggctggagtgcagtggtgcgatcttggctcactgcaagctccgcctcccaagttcatgccattctcctgtctcaacctcccgagtagctgggaccacaggcgcccgtcaccacaccaggctaattttttgtacttttagtagagatggggtttcaccgtgttagccagtatggtcttgatatcctgacctcgtgatccgcctgcctcggcctcctaaattgctgggattacaggcgtgagccaccacgcctggcctaatttt

SEQ ID NO: 59884 - DNA, 190 bp, Homo sapiens
cgacccacgctgtcgcccacgcgtcgcggacgcgtgggtccggacgcgtgggggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59885 - DNA, 347 bp, Homo sapiens
gggtacctgaggttcccgattttgacgcgtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagaacgcgtcaaaatcg

SEQ ID NO: 59886 - DNA, 354 bp, Homo sapiens
ctaagcagctgcagctgggtggttgccggcatcctgcaagtggtgaaaagtgtcaggcagccaaagctccttcttggagaagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59887 - DNA, 1773 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59888 - DNA, 1850 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59889 - DNA, 2023 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59890 - DNA, 2526 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59891 - DNA, 1768 bp, Homo sapiens
gtagaggctgcgtggttaattcggccgaggcagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59892 - DNA, 1946 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59893 - DNA, 1810 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59894 - DNA, 2486 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59895 - DNA, 1934 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggttgtaacctgcacgtggggtggtggtggaggctgaggccagtgctgtctgcgtggtccacatgaccctggggtctgctcacaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59896 - DNA, 1972 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaaaaaaaaaaggttcctaagcctcgagggcaatgaagggtgacacgcggagttgcccacatttggccggccgcgatagtgtgacaccacgcgggtcgtccggggggtccacccccggcggacaatggcggtgaccgcggggccgaggccccaaaacctttggcgcggaagaggaaagggtcccaccgtgtacgccacagg

SEQ ID NO: 59897 - DNA, 2172 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaaaaaaaaaaaaaaaaaaaaaaaaaaaaaaaaaaaaaaaccaaaaagaaacaagacacaacaaaaaaaaacaaagagcgcgggcgcgcgcgcgcgcagcgacgaacgactcctcccgccggcgaggcggcggcccacagcgccgcgccgccgaccccccgttttcgtgcacagcgggcggctgcgccccaatgagaggcggaggcgctcttctatatatatcatacgccgctcgaggccgcgcggggcgccgcgcgctcatatatacacaaaccaaggaggcggggaagcgcggcgacaaaaaccggcccccagcgcggcgcgagcattctctgtggggacgggcggacccccctctaggcggggggggaggggaccagtcggggggggcacccccctcc

SEQ ID NO: 59898 - DNA, 2271 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaggagaggctcttgtccttcctggggtccttgcgaggcgctggcattggagacgacaccaccccacttggcttctctccctgcctaagggaccccgcaccagggaagcagcccaaggccctggctgtgctcagctgggtcccctgagctgcacccacccacactggggagcacagcccagcccagcccagcccagcccagcgcggcccagcgcggcccgggttcctgcccggagcccagtgctcgccccagctctgtgtgggatgatggggcagcccatcttgcccacgggtggacagctgaccaaggtgggccagcccggggtgccctgccctgccaagccaagagggggacgctcaccagctttcaaaggtccgatgctgagtcagcaactacaagttcattgcaaagaagctgcctggcaatccccctcttttggacagggtctctctcttgcccaggctggagtgcagtggcgcaatcttggctcactacagcct

SEQ ID NO: 59899 - DNA, 1774 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtataacctggcgcttatatcatagatcgggggggggggcggcggggt

SEQ ID NO: 59900 - DNA, 1800 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagacgaccgaccgctccccgccacatgcggacgcgcgcgttgcgacacgtgaggtgcgggtgaggggggcgcgccggcgcccaccgggctcaccgagggcggccgc

SEQ ID NO: 59901 - DNA, 1184 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59902 - DNA, 1442 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttgggcgatggatgtgagtgacagagtggagagctcgcgaacctgttggcaaacacagctggtgaatgactcagaaatgctgggggagcggcatcttgatgtgaag

SEQ ID NO: 59903 - DNA, 1504 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaac

SEQ ID NO: 59904 - DNA, 1380 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59905 - DNA, 1440 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagccctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59906 - DNA, 1938 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagccctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaggagaggctcttgtccttcctggggtccttgcgaggcgctggcattggagacgacaccaccccacttggcttctctccctgcctaagggaccccgcaccagggaagcagcccaaggccctggctgtgctcagctgggtcccctgagctgcacccacccacactggggagcacagcccagcccagcccagcccagcccagcgcggcccagcgcggcccgggttcctgcccggagcccagtgctcgccccagctctgtgtgggatgatggggcagcccatcttgcccacgggtggacagctgaccaaggtgggccagcccggggtgccctgccctgccaagccaagagggggacgctcaccagctttcaaaggtccgatgctgagtcagcaactacaagttcattgcaaagaagctgcctggcaatccccctcttttggacagggtctctctcttgcccaggctggagtgcagtggcgcaatcttggctcactacagcct

SEQ ID NO: 59907 - DNA, 1010 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtggggtgtcccccggtcaggccggccgtggctgggtgggcctgcccgggggcggcgtccgg

SEQ ID NO: 59908 - DNA, 1484 bp, Homo sapiens
  misc_feature (1484)..(1484): n is a, c, g, or t
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagcctcaccctgcatatcctaggtttgaagagaaacgctcagatccgcttatttctgccagtatattttggacactttataatcattaaagcactttcttggcaggaaaaaaaaaaaaaaaactaataaaattacaaaatttatcaatttacctattaatttcattacactaaataatctttcttcttacatcttatattcataaaaataaattggccggggttttaacaacgtttgatttggaaacccttggttttccaaattaaaccgtttggacttcccctttggcccgttggctagcggtcccctttccn

SEQ ID NO: 59909 - DNA, 1415 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagagtacggagccctcggtgcagtgcgagccttggtccggcagggcaagccgatcaggacccacggtagcacaagacatcagagggggg

SEQ ID NO: 59910 - DNA, 751 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcattgtcctttgcaaggcacagctgccccaggacccgacggtgggaacagatgcctggccgtgagtcaggttccactcaccgcctcagtgtgtgtgggggac

SEQ ID NO: 59911 - DNA, 1109 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggtttgctttattttattgtttgggcaattcctggaatccggcctgcttgtgggaggaggcaggggccggtccctcgagggtggtgggagctgccagagctggagggatggtctgggggaaggcggctgtacggtggaaaggctggttggggccagagtgggaaacgggatgcggacgtcaggcttcacccccgacccaggggggagtgggaaagctggggtagtagctgggacgaggcccgggg

SEQ ID NO: 59912 - DNA, 798 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggtgggcggtcttggtcgtgcgaggtcggggagggagggtcctccgctctccattgcggagcttcgctccgggaccaccgggggaccggacgccgggccgcgaagct

SEQ ID NO: 59913 - DNA, 362 bp, Homo sapiens
gtggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatggtgaaaacccgtctctactaaaaatacaaaattagccgggcgtggtggcaggcgcctataatcccagctacttgggaggttgaggtaggagaatggcttgaactcaggaggcggaggttgcggtgagccgagatcgtgccactgcactccagccggctgacaagagcgaaactccttctca

SEQ ID NO: 59914 - DNA, 971 bp, Homo sapiens
aaataaggctagtacgaggcctggtgtgaatcggccgaggctggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtggggtgtcccccggtcaggccggccgtggctgggtgggcctgcccgggggcggcgtccgg

SEQ ID NO: 59915 - DNA, 1697 bp, Homo sapiens
  misc_feature (407)..(407): n is a, c, g, or t
  misc_feature (412)..(412): n is a, c, g, or t
  misc_feature (483)..(483): n is a, c, g, or t
  misc_feature (489)..(489): n is a, c, g, or t
  misc_feature (491)..(491): n is a, c, g, or t
  misc_feature (540)..(540): n is a, c, g, or t
  misc_feature (578)..(578): n is a, c, g, or t
  misc_feature (608)..(608): n is a, c, g, or t
gccgaaccgtggctattcctggtcgctggcgcgagtccgagaaggtgtgcggatttgctaccagtggtggacgcgggggagccaggccggtcctcagagcgcagcaccgccgatcccgggaacccggagcgcgcactcggaggccggaggccagagctcggcgtgtcccgagcctatcactcgttccagcctgcgaccttgagagaatgtgaagagtgagtgagctctgacgtctcagagagtctgagccagcccccttggtgctccaatgcgaggaaacggagcggtaccatgagaaaggcggggtgcagcgggcaggcgcgcgtgcaaggcgagtcctgccgacaggagacccagggcaagctggccaaccaaccctaagaaagtagccctgtgaggcctcgaanccaanaagggcatacgtctagagagagagcaaggcggtggcctggccagagcagccccgcgtgacgaataccagancatcantngtgcacacggcacaggtagacaccgcacatggggagcaaggactcgccnagacatagagacttggtaggaaaggacgtgatacaagngatgggcaatcttgcggcaaggcgcacctngcgtccggcacggtagcgacgcaggtgcaaccattggagttgtcagacgtggttcctcggttgaaggcgaagacacgattcatttactggaggactgggagagccgtggtgtccgctgtcccgggcggcttgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacattactggtctgagagaatgaggacggtgaggcctggagaaggaaagccttctggaggtattccggaggactcagagggggctcctggaacggctgagaactgggcccaacctggggttactggttctaggtgagaaagcaaacggtttggcgttgattaaaatttgggggaaaagaaaaaaaaaagggttttgggcgtagagataaggcgggtgggaaattataaatcgc

SEQ ID NO: 59916 - DNA, 2449 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59917 - DNA, 2276 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59918 - DNA, 2353 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttgccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59919 - DNA, 2425 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59920 - DNA, 1983 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59921 - DNA, 1793 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaaaaaaaccccctaaaaaaaa

SEQ ID NO: 59922 - DNA, 1857 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggttgtaacctgcacgtggggtggtggtggaggctgaggccagtgctgtctgcgtggtccacatgaccctggggtctgctcacaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59923 - DNA, 1826 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagttccacctccacgcagtgatgccgtggcactactcgcatgagtcctaggaacaatcgcagctgtcgatgtgagcatgatgcggaacggcgtacgaatgaggctcgacgtgctccatccacgtcttagtctctcagcctaggttgccagagttgggttctaggtgctaggcacgaactggtagtgcgcgtcgacgggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59924 - DNA, 1980 bp, Homo sapiens
  misc_feature (1980)..(1980): n is a, c, g, or t
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggaaaaaaaaaaaaaaaactaataaaattacaaaatttatcaatttacctattaatttcattacactaaataatctttcttcttacatcttatattcataaaaataaattggccggggttttaacaacgtttgatttggaaacccttggttttccaaattaaaccgtttggacttcccctttggcccgttggctagcggtcccctttccn

SEQ ID NO: 59925 - DNA, 2376 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggggcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59926 - DNA, 1260 bp, Homo sapiens
tcggactgtatctcgggccctactctcgtggccctgtggccaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 59927 - DNA, 1540 bp, Homo sapiens
gaagcgaaacaggctaggtcgaggctgggggtgaattggccgagggcacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtgtatgtgcacgcgctgggcgggtggtgcggccag

SEQ ID NO: 59928 - DNA, 426 bp, Homo sapiens
aaaggagaagtgagttgtagactgtgttggcagacacaaagtaaaataataatccagacaaatcaaccaaacccccttgtaatgcacttaccatcctctactttatatggttattttgaggattaaaagattgaggattaaaagagagattacgtataaagtgcctagtatctgcgctcagtaaacatatgcttacattcctcttccccttgtctgtatacatgtaaaggcgagcttagctaaacgttctaacttctcaaagatctcttgcacacggcccacgttaggacagtgacataaaaatatgaacgaagaagggccaggaagacagtgccttcctctacccaactagatatttctttctttagaaagaacaatacgttgtgaaccacagtttacctgctagtggaactgaaatgctgaggg

SEQ ID NO: 59929 - DNA, 192 bp, Homo sapiens
caagcaattggagacttttttcctgttatttttctaccatttatttctcatttcattatattatggtcagagaatatattttgaatgatttcatttattaatttttaaaaataacattaaaaaattttttaaaatgtgaatataccacatacagtataaagattgtacattctgtttttggacagttttcta

SEQ ID NO: 59930 - DNA, 570 bp, Homo sapiens
ttcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggtt

SEQ ID NO: 59931 - DNA, 618 bp, Homo sapiens
acgaggtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttcatcaggctt

SEQ ID NO: 59932 - DNA, 591 bp, Homo sapiens
gttgtagtgatctagaggatcccgaattcggctctctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttcatcaggctt

SEQ ID NO: 59933 - DNA, 467 bp, Homo sapiens
ctgaaggctgcgtgccaagaattcacacagtactcctgaaacaggatattactgaagcatttttctcaaacagaaacagatgtagttccctgttactgtcgccagtgttagtagatccttaaaattacctgacagcagtgtgcccctaaatgtactccccgctcctacacacatacacaagtgttttattttattttattttttggcaaagcctccttccttgatttgagggaagttagcctgggattcctgatgacagtaatagattctcagtgggtttgcagacggcagaggtggtgactgacaattctttattactcagaagaggatcttctctggtgaaaaatgattcaggattctgcagttggagattggatacaaaacctcagagaagggacacaaatagagatctttctcagcctcccctttcttgctaccctttgtagaggagagggaatgtctcatat

SEQ ID NO: 59934 - DNA, 309 bp, Homo sapiens
taatctcctcaataaccatcagtttttctgtatatatgtaaaagatcgtttatagatgagatcacgaagtaaccttttgcctttagtgatgctgatagttattaatagagcgctaaatttacttgagtaatatgtcaagcagtatattcagcaattcacatatattttttcatttaatcatgacaatagccttgtgaagttcttattgttcctttcaaagaagtgaaatgaaagcacacagaaatcatcaattgcctaaagtcaagtagtggagctggaactagaacctgtatctctttgatttcatta

SEQ ID NO: 59935 - DNA, 227 bp, Homo sapiens
ataatatattttattgagtctgatgatccaaagtattaccattttaacatacaatcaatgtcaaaattactaatgaaatattttacatttttcatactaaattttgaaatctagccacatttcaagtgctcaagagcctcaatgatgatttcctcataagagatgaatattagagttcttcttattagcccttgttggttgaacatggatttcttcttacatgcttg

SEQ ID NO: 59936 - DNA, 5156 bp, Homo sapiens
  misc_feature (1877)..(1877): n is a, c, g, or t
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggngggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaa

SEQ ID NO: 59937 - DNA, 3015 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaa

SEQ ID NO: 59938 - DNA, 5170 bp, Homo sapiens
  misc_feature (1891)..(1891): n is a, c, g, or t
cagagcgagactccaaaaaaaaaaaaaaaaaaaaaaaccaaagtacagtatacctggatgtccctccttccctaggaattctacctttactctcctaaaccaaacccctatgagctggaggaatataggggttaaaaaccacctgtccatcttctgcttctccatgtcccagtcagttggaaaacatatgggcagggcttgggggagggaatgttgagtcagaaatctctccctctctcccttcccctcccccactagctaaaccggatctggacaggtgactgaggaggcaggagtttcttttggcctgactcctcatcttataaagggagtcttctctgcagcttagatttaattggacctatctgtctgcctcattctcccactcctgagtctcaggtgtccttttggatgggtggagaggtaaggaagaggcgttccgctgcggcccttaaccctgtcacttctttccctacctcagagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggngggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaa

SEQ ID NO: 59939 - DNA, 4543 bp, Homo sapiens
  misc_feature (1264)..(1264): n is a, c, g, or t
tgttgctcgagtccacagtctggaagcggatccaagattttagacaaaattgtggaagggaaaaagaatccagttggtgataaatagggagattggtgaatggttatgatcatctaaccactccagtgagtgacccttacgtccagtcctcccatgacttcagctatcacccttacttctgctccttgtagcaacaaatagtgaagagacttttgaatctagagggcagcacttaagggatctagggtggcagatggggacaaatccagtgcagagctggagggagcctaggcccagagcaagggttccattggtagctggtgatgttcctccctcatctctaatggtgtcctcctcctcttccctagataactttgtggtggatcaaacatcctgtgtcagggcctgtcctcctgacaagatggaagtagataaaaatgggctcaagatgtgtgagccttgtgggggactatgtcccaaaggtgggtaggagatggtaagaagttgtaaagagacagcctttcctctgagcctgcgcagaccacccccactgaacctctcttacatttgcagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggngggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaa

SEQ ID NO: 59940 - DNA, 1528 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaaggtgggtaggagatggtaagaagttgtaaagagacagcctttcctctgagcctgcgcagaccacccccactgaacctctcttacatttgcagcctgtgagggaacaggctctgggagccgcttccagactgtggactcgagcaacattgatggatttgtgaactgcaccaagatcctgggcaacctggactttctgatcaccggcctcaatgggttagagatcctgccttccctccttagaccccagcccacgcacccctcacagttcatttcattggccaaaactttcctatgtggagctgactaggaatcaaagtcataaaattctagcctgttacaaagg

SEQ ID NO: 59941 - DNA, 790 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtaagtggccgtgatcaagattgctccccagtcccaccaaaccag

SEQ ID NO: 59942 - DNA, 1060 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaattagctgg

SEQ ID NO: 59943 - DNA, 5214 bp, Homo sapiens
  misc_feature (1935)..(1935): n is a, c, g, or t
cctctggatgcaagtgtctgtgtactattatgctatagagtgactttgtctgttctacctgcctggagatacaggaaaatgctcatgcttcacacccagaaccctcaggagagccgcatggactcctcagagcctccaggtttccaaccaggtaggaggagactcagacatcttttgtgagtgagggtacccgatggaggggaggaaggcctagagagggatgcaatcatcctcatcattcccagttttctgccagagcctggggacacaggaaggcaggaagactcggggctatctaaatccaagttcaaatcctgactcagttactcactaactggtgatggatacattagttccctgatctggacactttgcatccagagctctggatgcaaagtgtcaatgtgtaggagccggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggngggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaa

SEQ ID NO: 59944 - DNA, 1437 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatgggttagagatcctgccttccctccttagaccccagcccacgcacccctcacagttcatttcattggccaaaactttcctatgtggagctgactaggaatcaaagtcataaaattctagcctgttacaaagg

SEQ ID NO: 59945 - DNA, 226 bp, Homo sapiens
gcatatatccaaggaaatggaatcatgggttcaggttttagagcaagcaatttctgctctccctgcctagtttccacacccttaacacaggggcaatgatgtcacatcaaaacatatcatacaaatttgtgatgatgtttcaacaactaaacaccagaaaaatgcttagggcagggccgggtaggaggggcagaagccaatagtaacttaacatcactgctaaccc

SEQ ID NO: 59946 - DNA, 419 bp, Homo sapiens
taaagttaaatgtacacttaactttttgatccagcaattccactccaagatattttccaatagaaatgaaaacatatgtctacataaagtcttgcatgtgaatgacaactttattcataatagacaaaatcaggaaacaacttatattagtccattctcacactgctatgaagaaatacccaaggctgggtaattgataaatgaaagcggtttaattgactcacagttcagcatggctggggaggcctcaggaaacttatagtcatggcagaaggcacctcctcacagggcagcaggagagagaatgagtgcagagcgaagggggaagccctatacttataaaaccacctgatctcatgagaacttcctcactatcacgagaacagtatggaggaaaaccagccccatgattcaattac

SEQ ID NO: 59947 - DNA, 197 bp, Homo sapiens
agagtgctatatatgtatttactgtgaaaattaagcggctccaattccatttcgatgtgtaggctataggtgttacggcaagagctgcctggtacatctgaaggccgctacgcccaccttcagtgccagtttccttatcagaggagctcgtagagcctcacagaacacaaagtaagatatctgaggtgtttcaggct

SEQ ID NO: 59948 - DNA, 1266 bp, Homo sapiens
attgaacatgagactggtgagtcatgcataggaatggacagaggattgtgaaatccatcttcaactacagcttcagagcatgccattgagtcacttcaccttaattaaatctcaactcccactcctccattggaaccacaaactgaccttccaatctgtaggactcttcttgtcaaaattctgtttcttaatacagttcaatcattgtgagtagctggatcaatctttgcagaattgtatatcaagaagcggtagtaatatatgttcacatcctggacagcattaatagtcataaaagcaaattaaatagaaattctccttttatcttaattgaagccagacattgtacaatgtcagatattgtacaacatcatatatcatacaagtcagatattataatcgtaatatctaagtcagatactatttaatatttatacaatatcaaaatgatatggattaatatttctttagtttctaagcatgtgcagtattttctctggagtgaggtaatcccagcacatatttttcaagcattgaaggctgcaaaaagtaataatgtgagtaaagtcgaagtagttttcatttgaccctcataggacaagttttcctttccaatgagagttttaaattagcttatggaaaaaagaagaaaatggacaaataagttagagataaacttaatctgagaataagtttaaaacatacaggaaccagtcataccactaagatgtgcagacttgtcttgacattcatagctgcagcctctgcagacacaggaatgcgctaagactcctttcataacaacctgtgagagtacaccagtgcccagaggcacatacacgaaaagaagggagaaatggcttacatctcttctatggatacagggttggttttttaagtttctatcaagatttttagaaaatcactatgaattattttttaacatgtttgttggaaattttgctaaatatgagtacataccttcatactttattaaatatcaggcacagaatataattcaatgcattcttgataactcagagccactaccataaaagttaatgaacatattgggcttcgtgacattctgcatattttctgtttcttttcttattcacaggtagtcactgaggctaccagttccacttcttggcatttgctacttttgctcgaagttgatgtgagaatactgatttataagactactagatttgtacaatatttatgattcaataaactctaaatagaaaacacaacaaaacataa

SEQ ID NO: 59949 - DNA, 530 bp, Homo sapiens
tggactgcctatgccctaaggggaacacggccaaacatgtatttatctagaagatgtcagaaaaagtgattgatctgaaaaacttctgtctgagagattattaaagtaacttggaaagttgttttggaaataggaagaaagaccccaaggaagatattttcacagtttttctttatctgaagagctgttgccaactcatcacaaaagggtagaacaaggagtacagattaatttgaaaaatatttctgattctgaattcaaagtctaattgtaaaaaagaagatagcaatgagagagtatagtcccatacctagctaagtaaatgaaactgttaggtgtttatggaataggaaatatgactcttctagtcatcatggacccaaccttaaagaaagttacagttcactgggtgcggtagctcacgcctataatcccagcactttgggaggctgaagcgggtgaatcacgaggtcagtagctcgagaccagcctggccaacatggtaaaaccttgtctctactaaaaataca

SEQ ID NO: 59950 - DNA, 209 bp, Homo sapiens
tgaaaaatatttggaactctttagtacagaacagtttcaatatgagttaagaattatgcgatgactaccaaaaaagctaatgcgatcccaggctgcggtaacagaagcagagcagctcagctggggaacgtgatagtgataactactttgtactaggttagactgtaccgagagacctatgttcagttctgggagtgaaagtattttat

SEQ ID NO: 59951 - DNA, 443 bp, Homo sapiens
cattgtgcccggtcaggaaatgaggagttcttaaaggaccctgggaatgttgctagtgggcccatgtccagatatcttctcggcactggcaagaacagtgcctgagtgggtccttgtctacagaaatcatcactaaggatgaaatctcttaaaagggtgatccagatacaaacattatattaaatatttaatttctatatagagttggaggacatagactgtttcctagggaaactgaagggaggtataccaatgttgtatattaatctagatcacaaacatcttacactcaagtttaagtaaaaatccaaattaacagccacaaacagtggaccaaaatagagtaaactctgaaaaaacattatttgttattatttttgagtcttaagcgggaaatatcagagaagaaagttatgaaaatatgtaagtggactttattttgt

SEQ ID NO: 59952 - DNA, 491 bp, Homo sapiens
aaatacctaatacagtgtaaatggtatgtaaataattataccataaattttctattgtttttattgttgtattattattttacatatttttattttttcccaaatattctccatccattgttagttgaatccatggatgaggaacctgcagatatggaggtgcaacaacatggatggtagcataatctcaaaaaaattatgctaagtgaggctgggtaaggtggctcacacctgtaatcctaacactttgggaggccgaggtgggcggatcacttgaggtcaggagttcgaaaccagtctggccaacatggtgaaacttcgtctccactaaaagtacaaaaatttgctgggcgtggtggcacacgcctgtaatcccagctacttgggaggctgaggcaggagaattgcttgaacctgggaggtggaggttgcagtgagctgaggtcacgccgctgcactgcagcctgggtgacagtgagactccatcttat

SEQ ID NO: 59953 - DNA, 396 bp, Homo sapiens
gcaagattcccaccgcactgccagccagtgcttagggtggggatggcctgagctgacaggaagccctccaggtctggcgataagacgactgggtggaaatcccaaagggagcaaaaagaggaacggagacctgctttagataaaggaactgaaagggagtgtgggttgtcttcctgctctataggggaaggaaagggatgggcctaagtcatgctgagaccttataagggggcagcacactgggttcacctcctggctccattctgacctctgaccccgaggaatcgtctccctatttttcttagctttttcttggggctttttccctgacacaactcatcctacggcacctgaagcagggaatagaccttccttaggtcctcctctctgatcttt

SEQ ID NO: 59954 - DNA, 914 bp, Homo sapiens
taaaatgaagaaggtataggtaactataatatgaagaatgcattggaagtgtaaattttaaaggagtttgctgattaataactcttttgttgtaacttttgttcaatgatgtttgacaaatactttttttttttttaatttgaggcagagtctcactctgttgcccaaactggaatgcagtggcatgatctcagctcactgcaacctccgcctgttgggctcagagatcttcccgccccagcctcccgaggagctggaactacagccttgtgccaccacgcccagcaaatttttgtattttattgcagagatggcatttcaccatgttgcccaggctggtcttgaactactggacttaagcaatccgcccacctgggcctcccaaagtgctgagattacaggcatgagccaccgcgcctggctgacaaatactttttaaaaatatccaagtttctggattttattcacctctacaaaaatgatttaagtcctgtagaaacatgtgcccacaaatgacacagtaatctccagcaatgtgttcaacagcacgttgagcataattgagcataacagacatttttaaatttgttgtctcaaattccatttagatttggctattgatgcaaaattagggaggtcatttttcactagattactttcaatgctggaatccatacttaaaaaaaaaaaaagaagaaactagatttagtatatctttctttgccacttcaggcttccaaaggagaaaaattcatggataagtcattaactgttacaaatgcattatgtcttcagttgtgatggttatgataaaacatgtttattttatatttgtaatttagtaaaattagttgattcaaggagctctatcataaatgggaagtaataaaatgataataattaaagcaggttat

SEQ ID NO: 59955 - DNA, 820 bp, Homo sapiens
ttttgagcatttatgaaatggctgtgaacttcttctaacttctaactttccaagttgtctccttttggccctaggagtagaatttttctttaattctcagctcactgcaacctccgcctgttgggctcagagatcttcccgccccagcctcccgaggagctggaactacagccttgtgccaccacgcccagcaaatttttgtattttattgcagagatggcatttcaccatgttgcccaggctggtcttgaactactggacttaagcaatccgcccacctgggcctcccaaagtgctgagattacaggcatgagccaccgcgcctggctgacaaatactttttaaaaatatccaagtttctggattttattcacctctacaaaaatgatttaagtcctgtagaaacatgtgcccacaaatgacacagtaatctccagcaatgtgttcaacagcacgttgagcataattgagcataacagacatttttaaatttgttgtctcaaattccatttagatttggctattgatgcaaaattagggaggtcatttttcactagattactttcaatgctggaatccatacttaaaaaaaaaaaaagaagaaactagatttagtatatctttctttgccacttcaggcttccaaaggagaaaaattcatggataagtcattaactgttacaaatgcattatgtcttcagttgtgatggttatgataaaacatgtttattttatatttgtaatttagtaaaattagttgattcaaggagctctatcataaatgggaagtaataaaatgataataattaaagcaggttat

SEQ ID NO: 59956 - DNA, 491 bp, Homo sapiens
gacattgaaggaaatccgaggaatggacaagtgatgcaagagccagttgagttaccaaattagttctagaaagatctgaaaaagctcggtccgggttcctagctctatattcttgtagatgaatttcaggaacctttatggcagcttcggcgccgtggcttagttggttaaagcgcctgtctagtaaacaggagatcctgggttcgaatcccagcggtgcctttattcaattgaaacagcgtgattttgcggctaaatccacatcctttcatgtattgtttttatatcagaacgcgtaagagtttctgttctgcactcatagcacccacatttcctgcagagtcaagctgccactcccatgagatcgccactctaaaaggtggttctctaacttaggggcagaaatgttgcataggcctaagggtcctttgcttaactgatgccacaccccactggtgcaggtggactgggtcaggcggccgccccaccct

SEQ ID NO: 59957 - DNA, 321 bp, Homo sapiens
ctcgctctgtcacccaggctggagtgcagtggtgcaatcatggctcactgtagccttcaactcctaggctcaagcaatcctcctgccttgacctcccaaagtgctgggatgacaggcattagtcaccatgtacaaccagaactatgtatcttaaacaataatcataagttcatttaaaaaaatgtacagttctgctccatcacttccaaatcaatactattataagttgtctcattgctagacaatggaataggaaaaaaaaatcaacacaacagaaaatcctatgttctttaacaataagccctgatatttaggtaaaac

SEQ ID NO: 59958 - DNA, 5071 bp, Homo sapiens
gttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgaataaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttgaaacacgactc

SEQ ID NO: 59959 - DNA, 6809 bp, Homo sapiens
  misc_feature (1490)..(1490): n is a, c, g, or t
gaattccaaaattgtgatgtttcttgtatttttgatgaaggagaaatactgtaatgatcactgtttacactatgtacactttaggccagccctttgtagcgttatacaaactgaaagcacaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59960 - DNA, 6212 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggacataacgactatatgtgtccagccaccaaccagtgcaccattgataaaaacaggaggaagagctgccaggcctgccggctccgcaaatgctacgaagtgggaatgatgaaaggtggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59961 - DNA, 5974 bp, Homo sapiens
  misc_feature (655)..(655): n is a, c, g, or t
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccaccttctagaatgtgcctggctagagatcctgatgattggtctcgtctggcgctccatggagcacccagtgaagctactgtttgctcctaacttgctcttggacaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59962 - DNA, 2435 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaagaacttccaacactatgttgaataggatggtactggtaccaaaacagagatatagaccaatggaacagaacagagccctcagaaataataccacacatctacaaccatctgatctttgacaaacgtgacaaaaacaagaaatggggaaaggattccctatttaataaatagtgctgggaaaactggctagccatatgtagaaagctgaaactggatcacttccttacaccttatacaaaaattaattcaagatggattaaagacttaaatgttagaactaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgttctttgctggggtatctgaagactgaaaacacagcaaaagaaactaccatcagactgaacaggcaacctacagaatgggagaaaatttttgcaatctactcatctgacaaagggctaatatccagaatctacaaagaactcaaacaaatttacaagaaaaaaggaaccccatcaacaagtgggtgaaggatatgaacagacacttctcaaaagaagacatttatgcagccaacagacacatgaaaaaatgctcatcatcattggccatcagagaaatgcaaatcaaaaccacaatgagataccatctcacaccagttagaatggtgatcattagaaagtcaggaaacgacaggtgctggagaggatgtggagaaataggaacacttttacactgttggtgggactgtaaactggttcaaccattgtggaagacagtgtggcgattcctcagggatctacaactagaaataccatttgacccagccatcccattactgggtatatacccaaaggattataaatcatgctgctataaagacacatgcacacgtatgtttattgcggcactattcacaatagcaaagacttggaaccaacctaaatatccaacaacaataggctagattaagaaaatgtggcacatatacaccatggaatactatgcagccataaaaaaggatgagttcatatacttgtagggacatggatgaagctggaaaccatcattctcagcaaactattgcaaggacaaaaaaccaaacatgcatgttctcactcataggtgggaattgaacaataagaacacttggacacagggtggggaacattacacactggggcctgttgtggggtggggggaggggggagggatagcattaggagatataactaatgtaaatgatgagttaatgggtgcagcacaccaacatggcacatgtatacatatgtaacaaacctgcacattgtgcacatgtaccctagaacttaaagtataataaaaaatattt

SEQ ID NO: 59963 - DNA, 7119 bp, Homo sapiens
  misc_feature (1485)..(1485): n is a, c, g, or t
aacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59964 - DNA, 7107 bp, Homo sapiens
  misc_feature (1473)..(1473): n is a, c, g, or t
gagcctcaaatatctccaaaatctgataccaatccttttgattgtgaattatattctgtagctaccaaagaaggaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59965 - DNA, 7370 bp, Homo sapiens
  misc_feature (252)..(252): n is a, c, g, or t
  misc_feature (1405)..(1406): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaactgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59966 - DNA, 7661 bp, Homo sapiens
  misc_feature (252)..(252): n is a, c, g, or t
  misc_feature (1405)..(1406): n is a, c, g, or t
  misc_feature (2342)..(2342): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59967 - DNA, 2201 bp, Homo sapiens
  misc_feature (252)..(252): n is a, c, g, or t
  misc_feature (1405)..(1406): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacagaatggtgctgtcatgtggactgtcctcccgagtgtcccactggatgttcagagaatttatgtgaaggtcacgtcatttagcattgagatgctgtggttaccttcttccatttcttccataatatgcagccacatctatgtgtgaagaaatgtaatagataaaatttctctggacgcataataatgtgagaaagattgtcacatgtcccagcaaattgttattaatataaatttgttacttggcaagctgagattttgcaagatgttactc

SEQ ID NO: 59968 - DNA, 6878 bp, Homo sapiens
  misc_feature (1559)..(1559): n is a, c, g, or t
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59969 - DNA, 5948 bp, Homo sapiens
  misc_feature (629)..(629): n is a, c, g, or t
agcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59970 - DNA, 6095 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59971 - DNA, 8312 bp, Homo sapiens
  misc_feature (252)..(252): n is a, c, g, or t
  misc_feature (1405)..(1406): n is a, c, g, or t
  misc_feature (2678)..(2678): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59972 - DNA, 7094 bp, Homo sapiens
  misc_feature (1460)..(1460): n is a, c, g, or t
gacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagngaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59973 - DNA, 7858 bp, Homo sapiens
  misc_feature (252)..(252): n is a, c, g, or t
  misc_feature (1405)..(1406): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgccctttgggggtgccctgggatccctggggtagtccagctcttattcatttcccagcgtggccctggttggaagaagcagctgtcacagctgtgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttattta

SEQ ID NO: 59974 - DNA, 2879 bp, Homo sapiens
  misc_feature (252)..(252): n is a, c, g, or t
  misc_feature (1405)..(1406): n is a, c, g, or t
ccagtgccaagcttggtaccactagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttctttttngtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgcacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccannagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccagaaaggatggatatatgtgtgatcctgggtgtgccaaatgctgtggcttcctgaagcttagatttccagcttgtcaccttcaaggttaccttgtgaataggacttttttgagctatttctatccagttgactatggattttgcctgttgctttgtttccaccaactctccctgaagatgaggcgcacagacagacaactcacaggcaagaacagcctggtccatcttgaaagattctcaagactattctccacaagataattgtctacttttaaaaatattcagtaaagggaatttttgctgtta

SEQ ID NO: 59975 - DNA, 394 bp, Homo sapiens
ggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggtaagaatgcgaagcgcagcttttaagagtcaatagcttttcaagaacttgttgtgatgtcatgggagaaatagtgggggaaaaagaagcaataacatgttatgtaattggtttcaaggttacaggagatgtgttcatt

SEQ ID NO: 59976 - DNA, 2114 bp, Homo sapiens
atgggcctcgtggcacgggacgtttcaagtcctggcgtccccgcgagcaagcagcctgatcaggcctcgcagtgggacgttgggaagccggtgttggcagatgctgtggctgggaggagtccagagcgttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagtgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccgtgattgctgactacatgttctggcttggtggaggaagggaagagagcataagcaagctcatcaaactgtattggcaggccatgattgaggaagccatcaccagagctgaatctttctcggttatgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagttggacttgaaatgtg

SEQ ID NO: 59977 - DNA, 1021 bp, Homo sapiens
  misc_feature (969)..(969): n is a, c, g, or t
  misc_feature (983)..(983): n is a, c, g, or t
atgggcctcgtggcacgggacgtttcaagtcctggcgtccccgcgagcaagcagcctgatcaggcctcgcagtgggacgttgggaagccggtgttggcagatgctgtggctgggaggagtccagagcgttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgaggtatgggattaaagaaaatatagattggtgacaggaaactatgaaatggaaagttgcaattacattgaggggttctggccatactgtaataagcagtgatcatgaggtgaggatatgtaatgatattaggattttgcagttcccagtttacataaagcaaataaagactgancggccagccgcccnttatcccttctcaacatatactagacatgaaatatcga

SEQ ID NO: 59978 - DNA, 2214 bp, Homo sapiens
atgggcctcgtggcacgggacgtttcaagtcctggcgtccccgcgagcaagcagcctgatcaggcctcgcagtgggacgttgggaagccggtgttggcagatgctgtggctgggaggagtccagagcgttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagtgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccgtgattgctgactacatgttctggcttggtggaggaagggaagagagcataagcaagctcatcaaactgtattggcaggccatgattgaggaagccatcaccagagctgaatctttctcggttatgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggtaaaactttgagctgaaggaaaaagatctattattctcaaagaaaatgtccattttgggtcaaatctgtttggaggataaaaagaaacccaagttctttggtttgtttttttgttttccttttttaattaaatgcagctctctccctggaagtgtgaccaaaatcaaatatggatttatttaatctgcttcttttccaacaggctgtgttcatatgctttcgtgatttttcttcattatcatgctcattttcatattctattttcattatctgcgccttcgttctcggttttataattctttaaagccctttcatcagtgttttagtccactcctcaactatatttccacttttttcatttgaggaataatgactacatttcagggaactacaaagaaactagcacattgatgtttttagtaaaggactaacatactaatt

SEQ ID NO: 59979 - DNA, 718 bp, Homo sapiens
cattatctgcgccttcgttctcggttttataattctttaaagccctttcatcagtgttttagtccactcctcaactatatttccacttttttcatttgaggaataatgactacatttcagggaactacaaagaaactagcacattgatgtttttagtaaaggactaacatactaattgttagaaatagaggaacatcccatcattggctactggggtttaaatgcaggaagtgccgagatgcacctggacccaagtactcaggagacttgtgtgacacaacaggaccctctgaaaatgtgaaagttagtaatcttggttctccagtcaaactcaaagtattaagttctgatcaatcaactccccattcatcttcctcccatcactgtaagaacccaccaggggagactggcatcaggagatgtgaaacaaacaaaagaaccttcagtttaaaagccaaccctaagggattctggagcacctgaggaaacacgtgtcttttgtaatgaactcagaggccctgtgatatacagttgacccttgaacaacgtggtggttaggagcacagtcaaaaatctacaattagcttttggctccctaaaaacttaactaccaatagcctactattgactgaaagccttatggtaacataaagcgttgattcacacgtattgtatctaagtattatatactgtattcttacaatagtgtagtctagaa

SEQ ID NO: 59980 - DNA, 644 bp, Homo sapiens
atgggcctcgtggcacgggacgtttcaagtcctggcgtccccgcgagcaagcagcctgatcaggcctcgcagtgggacgttgggaagccggtgttggcagatgctgtggctgggaggagtccagagcgttcgccctgtccccgcggggctgagccacaactgcttaggagttttgggcaggatcgatggatgcaggaagcagtaggagtttggagaatctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagttggacttgaaatgtg

SEQ ID NO: 59981 - DNA, 225 bp, Homo sapiens
tgaagagattttgggcagaacagaggcagaaccaggttctaacagcaggaaagagaaattgaggggcaggagagcagtgagggaagacattttggagaggccaggacccggcaggcaacatgcagggttgcagggcggcagcgtgggtgtattgaaaagccttgactccttctttcttctaacaccttttattttgaagtctttaccactggcagctcagcgtac

SEQ ID NO: 59982 - DNA, 339 bp, Homo sapiens
ataacgaagactcttgagtattgaagatgaatatttattggggaaaaatgcaatgggaaataaagaaatcagaagattggagatgcttgacaaactactggaaattttattcccaagtaatttatttcttatttgtatcaatttgataaatattatgtaagttacgattatgttgaattgcaaataacaagagcaggtgtttatttttttttacataataacaagtccagaggtgtgtttagatgactgtgcaatgctaggccactggttctgatgttcttggcttcttccttatggtcacaagatggctgcttcagtaccagttcttatatctgcatt

SEQ ID NO: 59983 - DNA, 936 bp, Homo sapiens
tgctgggattacaggcatgagccattgcgcccggcaatgattatattttctaaactaaaagtctaaagctcatgattttacaatagatattttctgtttggtaagttttagtgtattaaaaatatcttttaaattttgataaatctagtacagaaatacatgatttttttacaacttgaactatagaagtatataacgtagacataaatcccttaaaatcctaacaatcgaaagcctaaagctcatgattttataacagatattttctgtttgggaagttttagtgtataaaaaaatcttttatatttttatagatctagtacagaaatacatgatctttattagaagtatataatgtggacattgaaaatcccttaaagtcctaacataaccaatatctataaatggcttgttgtgctgacatcatattataggatatcatggtcagacttgttttaacgctgtttcttttccatttaataatgtttgaacaatctttacagttcttggaaattttgacaaagatttaaaccacgttattggtacctttaataaatggtatttatgagaaataataacttacaggtgatcaggaccatatgagaaaacccagttttcttgatgctctaattaaataccagaaggtggccaggcacggtagctcacatctgtaatcccagcactttgggaggccaaggcaggcagatcacttgaagtcaggagtttgagaccagcctgcccaacatggtgaaaccgcatctctcttaaaaatacaaatacttagccaggcgttgtggcatgtgcctgtaatcccagttactcaggaggctgaggcaggagaattgcttgaatccgggaggtggagattgcagtgagctgagagggagccattgcactccagccttggtgacagtgagacttcatctcaaagataaa

SEQ ID NO: 59984 - DNA, 291 bp, Homo sapiens
ctttccaaccctttccaaatgttttttcaatcccttgagtgtctaggcttcctgcttttaaggcctcccttctaacccagggttgccccattcaccttaaaacatttttcaataacccagaaaaaaccaggctgaacatacccaagctccggaaccagcaaatcttgttcgaaccccgctgatgactcccaggggaagccaagaggacaaagacaaggatgaggacgaggacccaggacccgctggtgaatggcaactgctgtcaactcactttcaacctcagccagttgt

SEQ ID NO: 59985 - DNA, 468 bp, Homo sapiens
gtctgttattggtgtataagaacgcttgtgatttttgtacattgattttgtatcctgagactttgctgaagttgcttatcagcttaaggagattttgggctgagactatggggttttctagatatacaatcatgtcgtctgcaaacagggacaatttgacttcctcttttcctaattgaataccctttatttccttctcctgcttaattgccctggccagaacttccaactttcaaataaaattgtaagggttttgtaacacaatccaaagctaatgcaaaatgagaccttgaccaaatttgttttatacattaagtgaacttggatgggcaagattcattaatttattgagaacaaaaacaaaaccaaagcctaggcttggcaagatctaatcccaacactttggtaggtcaaagcgggagaatctcttgagcccaggagttcaagaccagccttagcaacatagag

SEQ ID NO: 59986 - DNA, 378 bp, Homo sapiens
tcagaatgaagccaacctcttagcctccagttttctcatttatttctcagctcaatttatgcatggaaaagggatgctaactattggggagggcacgctcagaggttaaaaaaaagaattaggaaggcattttagggttggaagatactctagaatcctgatctacacgtctgagatgaagaaactgaaacccagacaaggaccccaacctgtgtaaggttcagaacaagacttcctaacccccctccactctgccgcagaattgcaggtggcaagatgtggctttacacgtctttaaaaaacccaaataatcagaatttttttaaaaaaacagacagactaataaacaaataaagattcccagcctgaacagttacg

SEQ ID NO: 59987 - DNA, 553 bp, Homo sapiens
ctggcatagctatactaatattggacaaagtatactttaaagcaagaagcagttctagagcaaaagatggatattttgtgatgtaaagtgtttgatttaccagggaaataaaacaacaattctaaatgtatatgtaccaagtaaaattcgcagaactagtaggtgacagacaaatccacaatcataatgagagactttaattcaccttttagtggtagaaaagtacatacaaatatgcaaaattagtaatgatatagaaaatttaagcaacaaaataaacaactgatactaattgacataaatgatatacccaataaatgcggaatacgtattattttcaagtatgcatggaacatttaagaaagttgaccatatcataaatgaaaaagtaaatttcaacctatttcaaaggtttaaatcatacagagtaggatctacaaatttattatctaaatatctatatcagaataccatttgacccagccatcccattactgggtatatacccaaaggactataaatcatgctgctataaagacacatgcacgcgtat

SEQ ID NO: 59988 - DNA, 480 bp, Homo sapiens
tctcagtcctcagcacttccgcatccattatttctcttaatgaattaatatctgtgaggcgtgtgttataaataatattccctaactggatttaaaaggggagcttcctgggaatttcaggctctttaaggagtgtggcccttgtcaccctggggaccagggccactgcggccagaggtgtcagccagggtgaggacctcttccttttctttgagagcaggactaaattaacaagctgaagccagcttaccttggatgtggatcattctggcagtgttcaactttgagacaaggaagtgtgtgacattattgtcagcggagagaggccccaggcagaaggtcacttcctgaggtgtctggggagcactgcggcaagagacccccatttcccagcaaatgcttccttactcaatctttcggctacctggactttactaccacatctacagagccatcattggcttctaatgatgagcctga

SEQ ID NO: 59989 - DNA, 370 bp, Homo sapiens
atttcattattcggcatgtggacatccagttttaccaacatcatttattgaagaggctgtcctgtccctattgtgtgttcttcaaggcctgtttatttttaatgatgccattaactggggcacgcaatggagtaattctgaggccatttatttcctctcttaaagagaatctgcaaatggtcctagggattttttaaatgtgataaaataatagctaataatagctccaatttatagagtgcttactatgtgctaggcactgtgggaagcattttatgatcattgtcttatttaattgcagactgatggcatgcagacaaatctggcctgtaggctggaactgtgttttcaaaagataaatttgaatgac

SEQ ID NO: 59990 - DNA, 217 bp, Homo sapiens
cccggcctaagagttccggaaagttggagcggatgaatcagactatcaaaaatagtactattatcttccccgctggatatttaaaacaacaccacaagcaaggggcctcaaagcacctgctaaatttgagggaatgttatcctctcccccccctcccctgaccctggatattagagacaataacacaggggtaatgtacacccactgctttattggg

SEQ ID NO: 59991 - DNA, 583 bp, Homo sapiens
agacatttaatactataaaccaggggtcctcaacccccaggcctcggaccggtacctgtccatggctcgctaggaaccaggccaaacagcaggagtgagtggtggacgggtgagcattaccacctgagctcttcctcctgtcagatcagcagcagcattagattctcataggagcacaaaccctattgtgaactgtgcttacgaaggatctaggttgcacgttccttatgataatctaatgcctaataatctgagatggaacagtttcatcccaaaaccatccctaccgacatctgcagtcagtggaaaaattgtcttccacaaaaccagtacatgatgccaaaaaggttggggaccaccactataaacttccctcttagcactgcttttgctatatcccataggtttttaaagtatgtcgtgtttaattttcatttgtttcagcaatttttaaatttccatcttaatctctttgttgacccaggagcatattgtttaatttccatgtatgtatagtttccagagttgctcttggtatttatttatgattttattccactgtggtttgagaagatacttaata

SEQ ID NO: 59992 - DNA, 372 bp, Homo sapiens
caaggctggagggcagtggtgcagtcttggctcactgcaaactccgtcccccgagctcaagcaattttcatgcctcagcctcctgagtagctgggattacagaagcccaccaccacatccagctaatttttgtacttttagtagagacggccaggctggtctcaaactgctgacctcaggtgatccacccgcctcggcctcccagagtgcttggattacagtcatgagccaccactcccagcccctgatggtcttttggtttctgaacttttcaaggaatgcattttatacaactgtacccaaaattactatttatagatatcttaaacattgtagaatctcacaaaaacactagaatgctttcgaaccctt

SEQ ID NO: 59993 - DNA, 403 bp, Homo sapiens
gggaggcagaagttgcagtgagcccagattacaccactgcactccagctggtgacagagtgagactcttgtctcaaaaaaaatgaataagtaaataaaacataaaaataatatatataaaagtaaggtagcgatttcatttacatctctgtatctgcatgcaatacctagctcagtaatttacatatagtaggtgcttgataagtgtttattacattgaaatttgtaaaaagtgtttcataagaaatgtattgcataagaaatttaatgctgaggtaagccaatggcccatgcaatcttgtgtactgaaaaaataggttaattactcaccaagatgttaatctaaaaaagttcaatattaagtagttttttatttgtgtattggcaattcgttcaaaattacc

SEQ ID NO: 59994 - DNA, 780 bp, Homo sapiens
  misc_feature (394)..(394): n is a, c, g, or t
atagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctngagataaaagctagcagagaattcaactacattatctgacaatgaccatgagccccaaatatcccccgggggcttagagcctcccagtgaaaaacatttccgcgaaacagaagtctgaaaaggtcagggcccagactaaggctctgacgtctccccccagaggacagctcagcaccggctcaggctaggccctgacgtgtccccctgaagacaaatcataagctcagacctccgggaagccaccggaaccacccatttcctccccatgtttgtcaagccgccctcaggcgttgacgacaacccctcacctcaaaaaacttttcatggcacgcatatggctgaataaactaacaggagtctataaaagcgtggagacagttcaggag

SEQ ID NO: 59995 - DNA, 413 bp, Homo sapiens
gcagaggagtgtatggttctgttagctagctatgtgttgtgtcattttcctgttgaggcttgcgtgaggagccatgcagcactcttaccacagacacttggagaaccactggatagacagactggaatgacactgcctcgacccactgtagagccttctcttgcttcaggcaccattcagaagtagcagccttacaagttacttggtgtaaccggatcagagcagagcatccacttgtggtttgtgttgcctacaaaatctaaagaggccgaggactggcacaataatcctgaacttggaaaacaaagactgcataacattacctattgatatagcggccagatgtgactttggttgttttcccttcatatgtggttgtatacaaaatagtacattttgttaagtaggaaaaa

SEQ ID NO: 59996 - DNA, 357 bp, Homo sapiens
tccccttcttatataagaggtagtgtagcatatactctttaaagcatcttattatttttaaaaattaactaaagtccagctggatgtggtgctctcgcctgtattggggactgaggcgagtggatcacctgaggtcaggagttcaagaccagcctggccaacatggtaaaaccctgtctgtgctaaaaatataaaaattacccgggtgtggtggtgcatgcctgtaatcccagctactcgggaggctaaggcaggagaatcgcttcaactcaggtggtggaggttgcagcgagcctagatcacaccaccgcactccagcctgggcgacagagtgggactccgtctcaaaaaaaaaaa

SEQ ID NO: 59997 - DNA, 270 bp, Homo sapiens
attcctacacattgatgcattataccttccaaatacacagttcaactttaccgatattttcaatttaggacattaaggcactattttaaaacctatatgtttattaaatagtattatgaagaaatagttttaaaatcctgagttttttctctttttaaaaagagcagggataatgaattatcagaatggtcaatctggaaaaatatgttctaggatatgtaataaatgctaaatgttacctatattgatttgcagaactgttctattggc

SEQ ID NO: 59998 - DNA, 336 bp, Homo sapiens
caggcaaagctcctaccatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctttgcctggtaatcctctgcgca

SEQ ID NO: 59999 - DNA, 182 bp, Homo sapiens
gcggccgcctactactactactgctcgaattcaagcttctaacgatgtacggggacatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60000 - DNA, 7538 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60001 - DNA, 7828 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaaaaaaaaaaaaaaaaaaaaaaaaaaaaaaaaactttggggggggcttgggccccggaaaaagtttctctaaaccatcggtgggggccgggggcccaggtgggcacgcgtgaccgtgggcacaaagcgtgtcccgaggaagaacccgggccagagacaggggggcgggatttcccccccaagaaaaaagccccgggggggaacccccaggctcttggaacaatcccaaggggaggccggaggcacaaagggatgcctaccacaggggcccccagggaatccgaattaaatac

SEQ ID NO: 60002 - DNA, 7590 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaaaaaaaaaaaataaagtcgagcggccgcgaatttagtagtagtaggcggccgc

SEQ ID NO: 60003 - DNA, 6270 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcaga

SEQ ID NO: 60004 - DNA, 7144 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggtggaaagagcccggttaccggtcctcgtgccg

SEQ ID NO: 60005 - DNA, 6920 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcctcttagctccctgctagtgttcttccctcctccccagtttccagttaaaagtacccttggcctgggctttaa

SEQ ID NO: 60006 - DNA, 6852 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggtttgcctatattctaatattctagatattggttgcttacacttgaagctttcaaagtgagcttttgcccgtgcttaaaatcaataatgtgctttaccccttatgtgtcttattttggattatatctctaaactaatttcgttc

SEQ ID NO: 60007 - DNA, 7484 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60008 - DNA, 7190 bp, Homo sapiens
ggggatgcgctctgtctaggtcatgggtcggggcggcagactacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60009 - DNA, 7485 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60010 - DNA, 7485 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggttttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60011 - DNA, 6952 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcattcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60012 - DNA, 7477 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60013 - DNA, 5951 bp, Homo sapiens
cggtaccctcataggttcgcaggctaggaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60014 - DNA, 4581 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60015 - DNA, 4633 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaaaaaaaaaaaataaagtcgagcggccgcgaatttagtagtagtaggcggccgc

SEQ ID NO: 60016 - DNA, 5800 bp, Homo sapiens
gatcgaagcggatgccattcaaagcattctttgcagcctctgcttctccattcagccgaggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60017 - DNA, 3121 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttaaaaaaaaaaaaaaaaaaaaaaaaaaaaaaaactttggggggggcttgggccccggaaaaagtttctctaaaccatcggtgggggccgggggcccaggtgggcacgcgtgaccgtgggcacaaagcgtgtcccgaggaagaacccgggccagagacaggggggcgggatttcccccccaagaaaaaagccccgggggggaacccccaggctcttggaacaatcccaaggggaggccggaggcacaaagggatgcctaccacaggggcccccagggaatccgaattaaatac

SEQ ID NO: 60018 - DNA, 2975 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttaaacgcgagggaggagaggacacacagagaaggagcgaggagcgcggccgcgcggcgagagggccgcgcagcagggggggggcggcggcggcgagccccggcaggccgagggggcggggaggacgagggagagggagagagagag

SEQ ID NO: 60019 - DNA, 4298 bp, Homo sapiens
ataaaagaaagactgtctagtagtggtggcctctgggaaagaactgccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60020 - DNA, 2964 bp, Homo sapiens
aaagtgtgaagcaggaagtgagcactgtgcagacttacatgtacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60021 - DNA, 2601 bp, Homo sapiens
ggaaggccgggtgttaatcggccgagggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagcgaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaagctcactcctttagagtacctttaaatgaatttggtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60022 - DNA, 2230 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcatttta

SEQ ID NO: 60023 - DNA, 1518 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 60024 - DNA, 275 bp, Homo sapiens
ggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttct

SEQ ID NO: 60025 - DNA, 5287 bp, Homo sapiens
  misc_feature (5257)..(5257): n is a, c, g, or t
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccactgaactccagcccgggcaacagagcgtgactccgtctcaaancaaacaaacaaacaaacaaaaaacatttta

SEQ ID NO: 60026 - DNA, 4893 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgcgctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcagatgttctctattttattgagtggttgctt

SEQ ID NO: 60027 - DNA, 2831 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcatttta

SEQ ID NO: 60028 - DNA, 2402 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctacttaactatgaggggatggatgcttttgtctttctatgagg

SEQ ID NO: 60029 - DNA, 1911 bp, Homo sapiens
  misc_feature (1841)..(1841): n is a, c, g, or t
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggctaacctcctcactttttnctctctcttctttccttcttttttctaccaggctttttaaattacataagatcctgagtgttgttctgaa

SEQ ID NO: 60030 - DNA, 1332 bp, Homo sapiens
ggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctggtcattcggcgtgtgcaacacgccgagagcccatactgcacacgccgagaaaccacacctgactacttttttgtatcagctgctacaaaagttactgcattttttgcatttttattttttaaacctgattgtgtatgtgtgtgtatgtgtgtacgtgtgtgcacgtatgtgtgtgt

SEQ ID NO: 60031 - DNA, 2915 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctct

SEQ ID NO: 60032 - DNA, 4695 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggttacttgaaaaaaagaaaaaaaatttgggctggctgaaattacaaacttgggggcaagaggaggatcagagacggacatgggtaaaaacgggggtgaaggggggaaagaaaaaacggcgagaggaggggttttttttttttc

SEQ ID NO: 60033 - DNA, 4545 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60034 - DNA, 3204 bp, Homo sapiens
agcgggactccaggagttcaagaccagcctgggcaacatgacgagaccttgtctctacaaaaaatataaaaattagctgggtgtgatggtgtgggcctgtagtcccagctacttggaaagctgaggtgtgatgatcacttgagctcaggaggttgagactacagtgaaaagagatctcgccactgcattccatcctgggtgacagagcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60035 - DNA, 3230 bp, Homo sapiens
agcgggactccaggagttcaagaccagcctgggcaacatgacgagaccttgtctctacaaaaaatataaaaattagctgggtgtgatggtgtgggcctgtagtcccagctacttggaaagctgaggtgtgatgatcacttgagctcaggaggttgagactacagtgaaaagagatctcgccactgcattccatcctgggtgacagagtgagaccctatctctattaaaaaatgcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60036 - DNA, 3341 bp, Homo sapiens
agcgggactccaggagttcaagaccagcctgggcaacatgacgagaccttgtctctacaaaaaatataaaaattagctgggtgtgatggtgtgggcctgtagtcccagctacttggaaagctgaggtgtgatgatcacttgagctcaggaggttgagactacagtgaaaagagatctcgccactgcattccatcctgggtgacagagtgagaccctatctctattaaaaaatgctcaagcaatcttcccaccccagcctcccaagtagctgggtctagaggcgcatgccaccacgcctggacttgcaagatggaaaagctctagagatttgtttcacagtaatgcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60037 - DNA, 2788 bp, Homo sapiens
  misc_feature (12)..(12): n is a, c, g, or t
  misc_feature (35)..(36): n is a, c, g, or t
ggggcaccgacnccgcttcggtcttttggcccggnnggtcgtgggtaccatagccaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60038 - DNA, 3150 bp, Homo sapiens
gatagaggggggcagagatagtgggagagacagagtgaacgtgatgtggttctgagaaggatgtatattctgttgatttggggtggagagttctgtagatgtttattaggtccacttggtgcagagctgagttcatgtcctgtatatccttgttaaccttctgtctcattgatctgtctaatattgacagtggggtgttaaagtctcccattattattgtttgggagtctaagtctctttgtatgtctctaaggacttgctttataaatctgggtactcctgtactgggtgcatatatatttaggatagttaggtcttcttgctgaattgatccctttccattatgtaatggccttccttgtctcttttgatctttgttggtttaaagtctgttttgtcagggactaggattgcaaccagatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60039 - DNA, 2524 bp, Homo sapiens
accataataataaaaacagtgtggtattggtaaaataacagaccagcggaccagtggagcagaatagagatagacttgtgattgtataaacgattgatattgcaaagatggtaccgaaaatcaagtgaggagaggatagattgtttcagtctgtgatagaaaactgtttactatttgaaggaaaaaaacaaaatggattgttctctaattccacatacaaagttagaatccagatagattcataatttacgtgggaaaggtaagactttcagtttgatagaaaacaaatattaagaaaatatctttgtgatctagagttggaaaaggacttctaaaataaaccccttaacattagccttaaaacaaaaaaaagagttttttgattacataaaaagtaagcatttatgtttagcaaaggcctaccctggttaaaggtaacagaccagtgacattgggagaggaagtttgtgacatctaaaactcatggactggctgggcattgtgactcatacctgtaatcccagcactttaggaggctgaggtgatggatcacttgaggtcaggagttcgagaccagcctggccaacatggtgaaacctcgtctctactaaaaatatgaaaaaaaaaattagctgggcgtgatggtgggcgcctgtaatcccaactacttgggaggctgaggcaggagaatcacttgaagccaggaggtggaggttgcagtgagccaagatcgtgccactgcactccagcctgggtgacagagcaagactctgcctccaaaaaaaccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60040 - DNA, 1791 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggtgagttgttaaattccatggaagatagatctgtgggttacactggggtgtttcaaggacagatagagccttggatattacagattcttgcctagcaaaataaatatttattaaatatttttaattgaaattttctattcattatagtacttagcatggtttttgggtatattgtatgtgagaaagaaacatttgatttacttttatcttgaaatg

SEQ ID NO: 60041 - DNA, 866 bp, Homo sapiens
accataataataaaaacagtgtggtattggtaaaataacagaccagcggaccagtggagcagaatagagatagacttgtgattgtataaacgattgatattgcaaagatggtaccgaaaatcaagtgaggagaggatagattgtttcagtctgtgatagaaaactgtttactatttgaaggaaaaaaacaaaatggattgttctctaattccacatacaaagttagaatccagatagattcataatttacgtgggaaaggtaagactttcagtttgatagaaaacaaatattaagaaaatatctttgtgatctagagttggaaaaggacttctaaaataaaccccttaacattagccttaaaacaaaaaaaagagttttttgattacataaaaagtaagcatttatgtttagcaaaggcctaccctggttaaaggtaacagaccagtgacattgggagaggaagtttgtgacatctaaaactcatggactggctgggcattgtgactcatacctgtaatcccagcactttaggaggctgaggtgatggatcacttgaggtcaggagttcgagaccagcctggccaacatggtgaaacctcgtctctactaaaaatatgaaaaaaaaaattagctgggcgtgatggtgggcgcctgtaatcccaactacttgggaggctgaggcaggagaatcacttgaagccaggaggtggaggttgcagtgagccaagatcgtgccactgcactccagcctgggtgacagagcaagactctgcctccaaaaaaaccaccgcgcctggccagggactatactctttttaaaatagacatttgtggggctcacacaatatatgaaatagtaccctct

SEQ ID NO: 60042 - DNA, 4573 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60043 - DNA, 4519 bp, Homo sapiens
  misc_feature (12)..(12): n is a, c, g, or t
  misc_feature (14)..(15): n is a, c, g, or t
cttcccctccgngnngacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgttttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaa

SEQ ID NO: 60044 - DNA, 2266 bp, Homo sapiens
gaattccggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcaggcccttccaggcgcagtgtggccaccggtactgctccttctgcctggccagcatcctcaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60045 - DNA, 778 bp, Homo sapiens
tagagacagggtttctccactttggtgaggctggtctcgaactcctgacctcaggtgatccacctgccttggcactcccaaagtgctgggattacaggctggtctcgaactcctggcctgaagtgatcctccaacctcagcctcccaagtagctgggattacaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctgggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggaaagatgcctgcgtgtggcatggtg

SEQ ID NO: 60046 - DNA, 663 bp, Homo sapiens
  misc_feature (9)..(9): n is a, c, g, or t
  misc_feature (341)..(341): n is a, c, g, or t
  misc_feature (373)..(373): n is a, c, g, or t
  misc_feature (483)..(483): n is a, c, g, or t
  misc_feature (492)..(492): n is a, c, g, or t
  misc_feature (499)..(499): n is a, c, g, or t
  misc_feature (546)..(546): n is a, c, g, or t
  misc_feature (584)..(584): n is a, c, g, or t
  misc_feature (592)..(592): n is a, c, g, or t
  misc_feature (596)..(596): n is a, c, g, or t
  misc_feature (599)..(599): n is a, c, g, or t
  misc_feature (603)..(603): n is a, c, g, or t
agcggagtntcgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggcaacgacttccagnggtgcttctcgcaggtcaagggggccatcgangaggacgtggccgaagcggacatcatttccaccgttgagtttaattactctggagatcttcttgcaacaggagacaagggcggcagagttgttatttttcagcgtgaacnagagaatanaagccgncctcattctaggggagaatataatgtttacagcacctttcaaagtcntgaaccggagttgactatttgaaaagtctagaaattgnggaacaanttantanaatnaggtggttaccagaacagaatgctgctcatttgctactgtctagcaatgatacaactata

SEQ ID NO: 60047 - DNA, 361 bp, Homo sapiens
ttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgaggtggagaggactaggacagggaggatgggc

SEQ ID NO: 60048 - DNA, 2268 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60049 - DNA, 2380 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagctgctggctcagccgattgtatatgctgggagctctgcactaagcgttgggtgaagggtcagcattgtggaggccctgccacggaggtggtcttcttgggagctgcactcagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60050 - DNA, 2293 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctcaaaaaaaacacatccacacaacagt

SEQ ID NO: 60051 - DNA, 2431 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctctctgtggtcagtggcatccatttgattccaggttgcctgcggcttccagccttggcagtggtgaccctctgcgggtcctcctggcctctcctctcacagacccctccccacggggtgctagcgcctgcctgcttctctagctagccaggcgtgtgttctct
